(12) United States Patent
Aw et al.

(10) Patent No.: US 11,174,505 B2
(45) Date of Patent: Nov. 16, 2021

(54) SIMPLE ONE-STEP REAL-TIME MOLECULAR SYSTEM FOR MICRORNA DETECTION

(71) Applicant: AGENCY FOR SCIENCE, TECHNOLOGY AND RESEARCH, Singapore (SG)

(72) Inventors: Sherry Aw, Singapore (SG); Yin Nah Teo, Singapore (SG); Stephen Michael Cohen, Singapore (SG); Melissa Xue Mei Tang, Singapore (SG)

(73) Assignee: AGENCY FOR SCIENCE, TECHNOLOGY AND RESEARCH, Singapore (SG)

( * ) Notice: Subject to any disclaimer, the term of this patent is extended or adjusted under 35 U.S.C. 154(b) by 264 days.

(21) Appl. No.: 16/079,992

(22) PCT Filed: Feb. 24, 2017

(86) PCT No.: PCT/SG2017/050086
§ 371 (c)(1),
(2) Date: Aug. 24, 2018

(87) PCT Pub. No.: WO2017/146653
PCT Pub. Date: Aug. 31, 2017

(65) Prior Publication Data
US 2019/0382830 A1    Dec. 19, 2019

(30) Foreign Application Priority Data

Feb. 24, 2016   (SG) .......................... 10201601384T

(51) Int. Cl.
*C12Q 1/6816*    (2018.01)

(52) U.S. Cl.
CPC ..... *C12Q 1/6816* (2013.01); *C12Q 2600/178* (2013.01)

(58) Field of Classification Search
CPC ..................... C12Q 1/6816; C12Q 2600/178
See application file for complete search history.

(56) References Cited

U.S. PATENT DOCUMENTS

2015/0141282 A1    5/2015   Jaffrey et al.

FOREIGN PATENT DOCUMENTS

EP            0745690 A2     12/1996
WO    WO 2013/016694 A1      1/2013

OTHER PUBLICATIONS

Bhadra, Sanchita; et al.; "Spinach Molecular Beacon Triggered by Strand Displacement"; RNA, vol. 20. 1183-1194, (2014); 12 pp.
Brennecke, Julius; et al.; bantam Encodes a Developmentally Regulated microRNA that Controls Cell Proliferation and Regulates the Proapoptotic Gene hid in *Drosophila*; Cell. 113. 25-36, (2003); 12pp.
DiLeva, Gianpiero; et al., miRNA Profiling of Cancer. Curr Opin Genet. Dev., 23, 3-11. (2013); 14 pp.

(Continued)

*Primary Examiner* — Joseph G. Dauner
(74) *Attorney, Agent, or Firm* — Womble Bond Dickinson (US) LLP

(57) ABSTRACT

The present application discloses an isolated nucleic acid sequence for detecting the presence of a target nucleic acid sequence, a ribozyme for detecting the presence of a target nucleic acid sequence and uses thereof.

14 Claims, 21 Drawing Sheets

Specification includes a Sequence Listing.

(56) References Cited

OTHER PUBLICATIONS

Dong, Haifeng; et al.; "The use of Polyethylenimine-grafted Graphene Nanoribbon for Cellular Delivery of Locked Nucleic Acid Modified Molecular Beacon for Recognition of MicroRNA" Biomaterials. 32, (2011) 3875-3882. 10 pp.

Ebert, Margaret; et al.; Roles for microRNAs in Conferring Robustness to Biological Processes. Cell, 149, 515-524. (2012); 20 pp.

Esteller, Manel; "Non-coding RNAs in Human Disease"; Nature Reviews Genetics 12, 861-874, (2011); 14 pp.

Farazi, Thalia; et al. "MicroRNA Sequence and Expression Analysis in Breast Tumors by Deep Sequencing"; Cancer Research; 71(13): 4443-4453; (2011); 16 pp.

Herranz, Hector; et al.; MicroRNAs and Gene Regulatory Networks: Managing the Impact of Noise in Biological Systems. Genes & Dev., 24, 1339-1344; (2010); 6 pp.

Huang, Hao; et al.; A G-quadruplex-containing RNA Activates Fluorescence in a GFP-like Fluorophore. Nat. Chem. Biol. 686-691; (2014); 22 pp.

Maciotta, Simona; et al.; "The Involvement of MicroRNAs in Neurodegenerative Diseases". Frontier Cellular Neuroscience., 7, 265; (2013); 17 pp.

Mendell, Joshua T.; et al; "MicroRNAs in Stress Signaling and Human Disease"; Cell 148(6): 1172-1187; (2012); 26 pp.

Paige, Jeremy S.; et al.; "RNA Mimics of Green Fluorescent Protein"; Science, 333(6042) 642-646; (2011); 14 pp.

Paige, Jeremy S.; et al; "Fluorescence imaging of cellular metabolites with RNA"; Science, 335. (6073) 1194; 2012; 3 pp.

Rooij, Eva; "The Art MicroRNA Research"; Circulation Research (2011);108:219-234; 16 pp.

Sayed, Danish; et al.; "Micrornas in Development and Disease"; Physio/ Rev 91: 827-8871 (2011); 61 pp.

Winter, Julia; et al.; "Many Roads to Maturity: MicroRNA Biogenesis Pathways and their Regulation"; Nature Cell Biology 11, 228 234; (2009); 8 pp.

Yoo, Byunghee; et al.; Detection of miRNA Expression in Intact Cells Using Activatable Sensor oligonucleotides. Chem. Biol., 21(2), 199-204; (2014); 13 pp.

Zhou, Yuntao; et al.; "A Dumbbell Probe-Mediated Rolling Circle Amplification Strategy for Highly Sensitive MicroRNA Detection"; Nucleic Acids Res., vol. 38, No. 15; (2010); 5 pp.

PCT Notification of the "International Preliminary Report on Patentability" for Counterpart PCT Application No. PCT/SG2017/050086; date of completion, May 4, 2017; 7 pp.

IP Office of Singapore—Notification of Transmittal of the International Search Report & the Written Opinion of the International Searching Authority, or the Declaration, with the International Search Report & Written Opinion dated May 9, 2017 for International Application No. PCT/SG2017/050086 (13 pgs).

Aw, S.S., et al., "A Conformation-induced Fluorescence Method for microRNA Detection." Nucleic Acids Research, Mar. 6, 2016, vol. 44, No. 10, pp. e92:1-9.

Ketterer, S., et al., "Systematic Reconstruction of Binding and Stability Landscapes of the Fluorgenic Aptamer Spinach." *Nucleic Acids Research*, Sep. 22, 2015, vol. 43, No. 19, pp. 9564-9572.

Song, W., et al., "Plug-and-Play Fluorophores Extend the Spectral Properties of Spinach." *J. Am. Chem. Soc.*, Jan. 6, 2014, vol. 136, No. 4, pp. 1198-1201.

Warner, K. D., et al., "Structural Basis for Activity of Highly Efficient RNA Mimics of Green Fluorescent Protein." *Nature Structural & Molecular Biology*, Jul. 15, 2014, vol. 21, No. 8, pp. 658-665.

Duan et al., "Quadratic isothermal amplification for the detection of microRNA" Nature Protocols, vol. 9, Feb. 13, 2014, pp. 597-607.

Jia et al., "Ultrasensitive detection of microRNAs by exponential isothermal amplification" Angewandte Chemie International Edition, vol. 49 Issue 32, Jul. 22, 2010, pp. 5498-5501.

Li et al., "MicroRNA detection by microarray" Analytical and Bioanalytical Chemistry, vol. 394, Jan. 9, 2009, pp. 1117-1124.

Thomson et al., "A custom microarray platform for analysis of microRNA gene expression" Nature Methods, vol. 1 No. 1, Sep. 29, 2004, pp. 47-53.

Kloosterman et al., "In situ detection of miRNAs in animal embryos using LNA-modified oligonucleotide probes" Nature Methods, vol. 3 No. 1, Jan. 2006, pp. 27-29.

Hwang et al., "Smart magnetic fluorescent nanoparticle imaging probes to monitor microRNAs" Small, vol. 6 Issue 1, Dec. 28, 2009, pp. 81-88.

Rogers et al., "Fluorescent monitoring of RNA assembly and processing using the split-spinach aptamer" ACS Synthetic Biology, vol. 4 No. 2, May 8, 2014, pp. 162-166.

Kang et al., "Molecular beacon-based bioimaging of multiple microRNAs during myogenesis" Biomaterials, vol. 32 Issue 7, Dec. 3, 2010, pp. 1915-1922.

A

B

| miRNA | Sequence |
|---|---|
| Bantam5p miRNA | CCGGUUUUCGAUUUGGUUUGACU (SEQ ID NO.: 2599) |
| Bantam5p_2nt (2nt mutation in seed) | CGGCUUUUCGAUUUGGUUUGACU (SEQ ID NO.: 2602) |
| Bantam5p_3nt (3nt mutation in seed) | CGGCUUAUCGAUUUGGUUUGACU (SEQ ID NO.: 2603) |

| miRNA | Sequence |
|---|---|
| bantam-5p | CCGGUUUUCGAUUUGGUUUGACU (SEQ ID NO: 2599) |
| bantam-5p (3nt mutation in seed) | CGGCUUAUCGAUUUGGUUUGACU (SEQ ID NO: 2603) |
| miR-263a | AAUGGCACUGGAAGAAUUCACGGG (SEQ ID NO: 2609) |
| miR263a (3nt mutation in seed) | AAACGGACUGGAAGAAUUCACGGG (SEQ ID NO: 2610) |
| miR-1000 | AUAUUGUCCUGUCACAGCAGU (SEQ ID NO: 2611) |
| miR1000-5p (3nt mutation in seed) | AUUAUCUCCUGUCACAGCAGU (SEQ ID NO: 2612) |

C

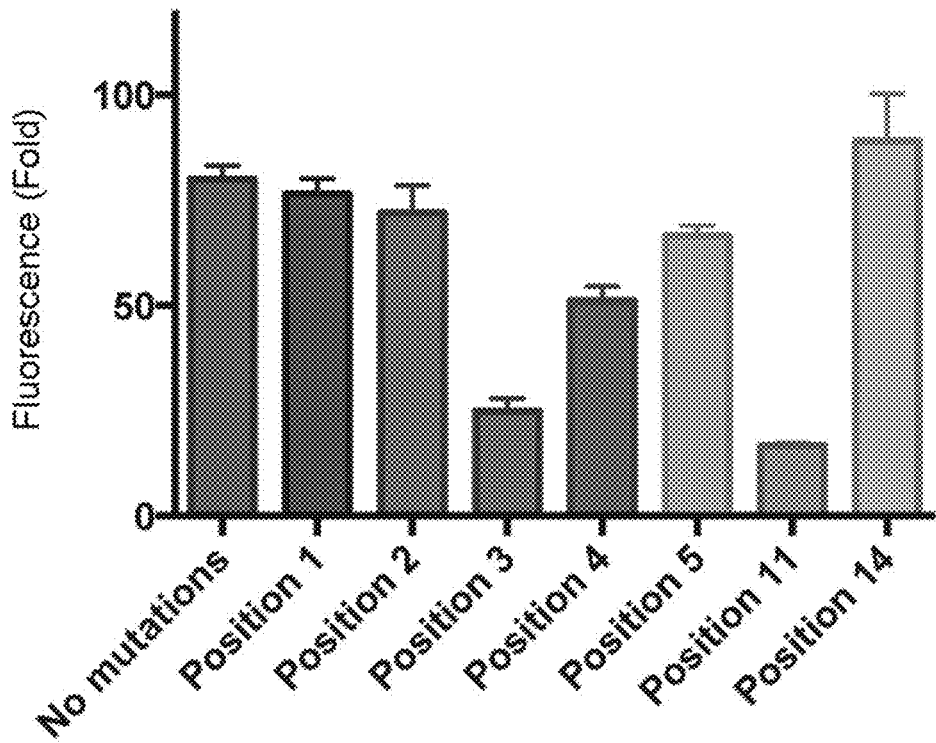

| miRNA | Sequence |
|---|---|
| bantam-5p_Mut Position 1 | GCGGUUUUCGAUUUGGUUUGACU (SEQ ID NO: 2604) |
| bantam-5p_Mut Position 2 | CGGGUUUUCGAUUUGGUUUGACU (SEQ ID NO: 2605) |
| bantam-5p_Mut Position 3 | CCCGUUUUCGAUUUGGUUUGACU (SEQ ID NO: 2606) |
| bantam-5p_Mut Position 4 | CCGCUUUUCGAUUUGGUUUGACU (SEQ ID NO: 2607) |
| bantam-5p_Mut Position 5 | CCGGAUUUCGAUUUGGUUUGACU (SEQ ID NO: 2608) |
| bantam-5p_Mut Position 11 | CCGGUUUUCGCUUUGGUUUGACU (SEQ ID NO: 2613) |
| bantam-5p_Mut Position 14 | CCGGUUUUCGAUUAGGUUUGACU (SEQ ID NO: 2598) |

Figure 11 (Cont.)

| Bantam-3p | UGAGAUCAUU<u>UU</u>GAAAGCUGAUU (SEQ ID NO.: 2617) |
|---|---|
| U ➔ G | UGAGAUCAUUU<u>G</u>GAAAGCUGAUU (SEQ ID NO.: 2655) |
| U ➔ C | UGAGAUCAUUU<u>C</u>GAAAGCUGAUU (SEQ ID NO.: 2656) |
| U ➔ A | UGAGAUCAUUU<u>A</u>GAAAGCUGAUU (SEQ ID NO.: 2657) |

SIMPLE ONE-STEP REAL-TIME MOLECULAR SYSTEM FOR MICRORNA DETECTION

CROSS-REFERENCE TO RELATED APPLICATIONS

This patent application is a U.S. National Phase application under 35 U.S.C. § 371 of International Application No. PCT/SG2017/050086, filed on 24 Feb. 2017, entitled A SIMPLE ONE-STEP REAL-TIME MOLECULAR SYSTEM FOR MICRORNA DETECTION, which claims the benefit of priority of Singapore provisional application No. 10201601384T, filed on 24 Feb. 2016, the contents of which were incorporated by reference in their entirety for all purposes.

INCORPORATION BY REFERENCE

The content of the ASCII text file of the sequence listing named "9322P124_Updated_Sequence_Listing_ST25", which is 598 kb in size, was created on and electronically submitted via EFS-Web Dec. 28, 2020 is incorporated herein by reference in its entirety.

FIELD OF THE INVENTION

The present invention relates to molecular biology in particular molecular sensor. In particular, the present invention relates to a molecular sensor for the detection of a target nucleic acid sequence, specifically, a target miRNA.

BACKGROUND OF THE INVENTION

MicroRNAs (miRNAs) are short, non-coding RNAs that regulate many important biological processes in development, physiology and disease. miRNAs are often involved in regulatory feedback loops, where aberrations in cellular processes trigger miRNAs to act to restore target levels. Therefore, the ability to respond dynamically to changing conditions is inferred to be an essential function of miRNAs. miRNAs are also an emerging class of biomarkers, which are misregulated in cancer and neurodegenerative diseases. miRNA expression signatures have shown promise for use in prognosis and as predictors of clinical response. Therefore, tools for the detection and quantification of miRNAs have broad applicability.

Current methods to detect miRNAs include northern blotting, amplification-based methods such as real-time polymerase chain reaction (PCR), rolling circle amplification and isothermal amplification, deep sequencing, as well as hybridization-based techniques such as microarrays and in situ hybridization. These methods are suitable for the detection of purified RNA in vitro. To study miRNAs in vivo, quencher-fluorophore based systems such as molecular beacons have been used. These nucleic acid-based probes require additional delivery agents for efficient cellular uptake. For instance, polyethyleneimine-grafted graphene nanoribbons were used to deliver LNA-modified molecular beacon probes to detect miR-21 in HeLa cells. An alternative approach involves the use of genetically encoded sensor transgenes with miRNA target sites introduced into the 3' UTR of a GFP reporter. Down-regulation of the sensor therefore reports miRNA activity. This approach allows for good spatial resolution to visualize miRNA activity in vivo, but has limited capacity for temporal resolution of miRNA dynamics, due to the relatively slow turnover of the GFP reporter.

Thus, there is a need for the provision of improved molecular sensors, system and methods which can be used for the detection of miRNAs.

SUMMARY OF THE INVENTION

In the first aspect, the present invention refers to an isolated nucleic acid sequence for detecting the presence of a target nucleic acid sequence, wherein the isolated nucleic acid sequence is capable of forming bimolecular interactions with the target nucleic acid sequence, wherein the isolated nucleic acid sequence forms a ternary complex stabilizing a detection agent when binding the target nucleic acid sequence and wherein the isolated nucleic acid sequence comprises the following structure:

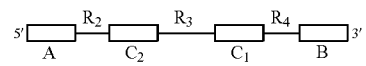

wherein A and B are domains forming stabilizing secondary structures, wherein $C_1$ and $C_2$ are domains that bind to the target nucleic acid sequence, wherein $R_2$ and $R_4$ are regions of nucleic acids that do not bind with the target nucleic acid sequence, and wherein $R_3$ is a region of nucleic acids capable of stabilising a detection agent upon the isolated nucleic acid binding to the target nucleic acid sequence.

In the second aspect, the present invention provides a method of detecting a target nucleic acid sequence in an animal, wherein the method comprises using the isolated nucleic acid sequence of the first aspect.

In the third aspect, the present invention provides a method of determining if a subject has a disease or is at increased risk of developing a disease, wherein said method comprises providing a sample comprising nucleic acids from a subject and detecting one or more target nucleic acid sequences that bind to the isolated nucleic acid of the first aspect.

In the fourth aspect, the present invention provides a method of treating a patient which has a disease or is at increased risk of developing a disease, wherein said method comprises (i) providing a sample comprising nucleic acids from a patient and detecting one or more target nucleic acid sequences that bind to the isolated nucleic acid sequence of the first aspect, and (ii) administering to the patient one or more therapeutic agents for the treatment of the disease associated with the one or more target nucleic acid sequences detected in (i).

In the fifth aspect, the present invention provides a kit comprising the isolated nucleic acid of the first aspect and a detection agent described herein.

BRIEF DESCRIPTION OF THE DRAWINGS

The invention will be better understood with reference to the detailed description when considered in conjunction with the non-limiting examples and the accompanying drawings, in which.

Figure 1:
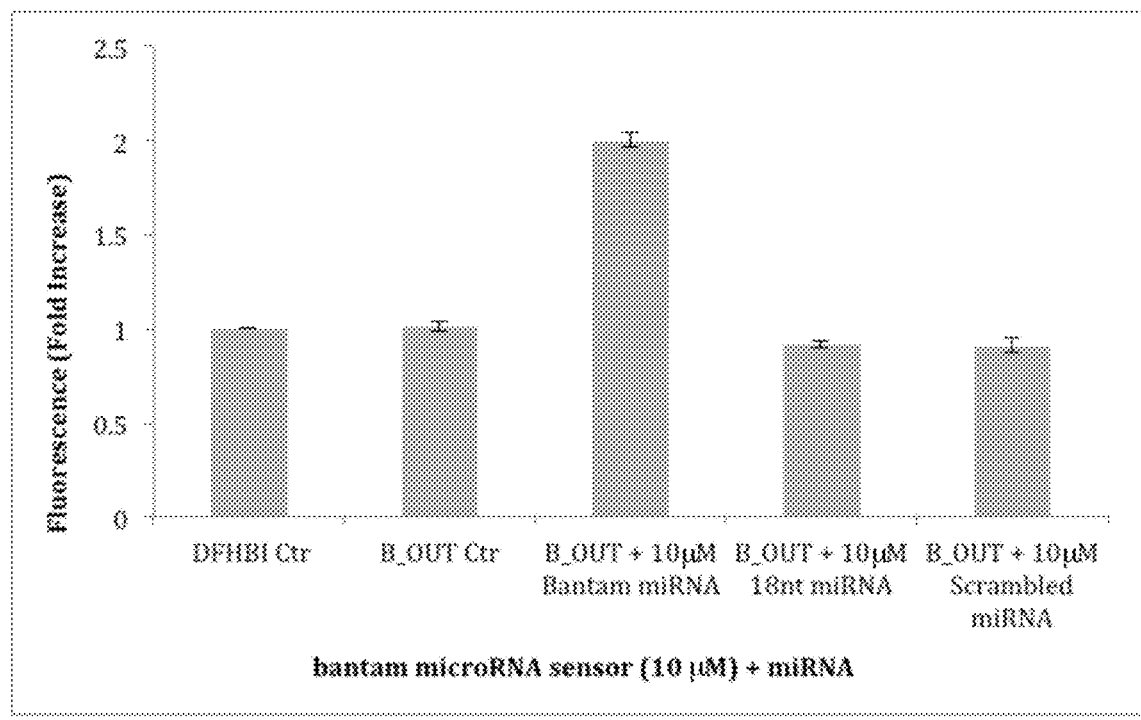
FIG. 1A shows a bar chart of the fluorescence levels of Pandan bantam miRNA sensor used with different miRNA samples. The sequences of the different miRNA samples are listed in FIG. 1B. The y-axis represents the fold increase in the fluorescence level as compared to the DFHBI control.

The bars represent, from left to right, the following experimental setups: DFHBI control (negative control); Pandan bantam miRNA sensor+DFHBI; Pandan bantam miRNA sensor+DFHBI+10 µM bantam miRNA; Pandan bantam miRNA sensor+DFHBI+10 µM of a random 18 nucleotides long miRNA; Pandan bantam miRNA sensor+DFHBI+ scrambled mRNA. The results demonstrate that a fold increase in the fluorescence level of the Pandan bantam miRNA sensor only occurs when the target bantam miRNA is present in the sample. The data presented in FIG. 1 is only illustrating that in the absence of the target miRNA, the sensor will not show any significant increase in fluorescence level. The sensor used in the experiments illustrated in FIG. 1 is an intermediate form of the sensor, that does not include the variable stem-loop P4. This sensor could be optimized to arrive at the final Pandan sensor design by incorporating the variable stem-loop P4, which shows a more significant fold increase in fluorescence levels, as shown in FIG. 2 (80 to 100 fold increase when the Pandan bantam sensor binds to 1 µM bantam miRNA).

Figure 2:
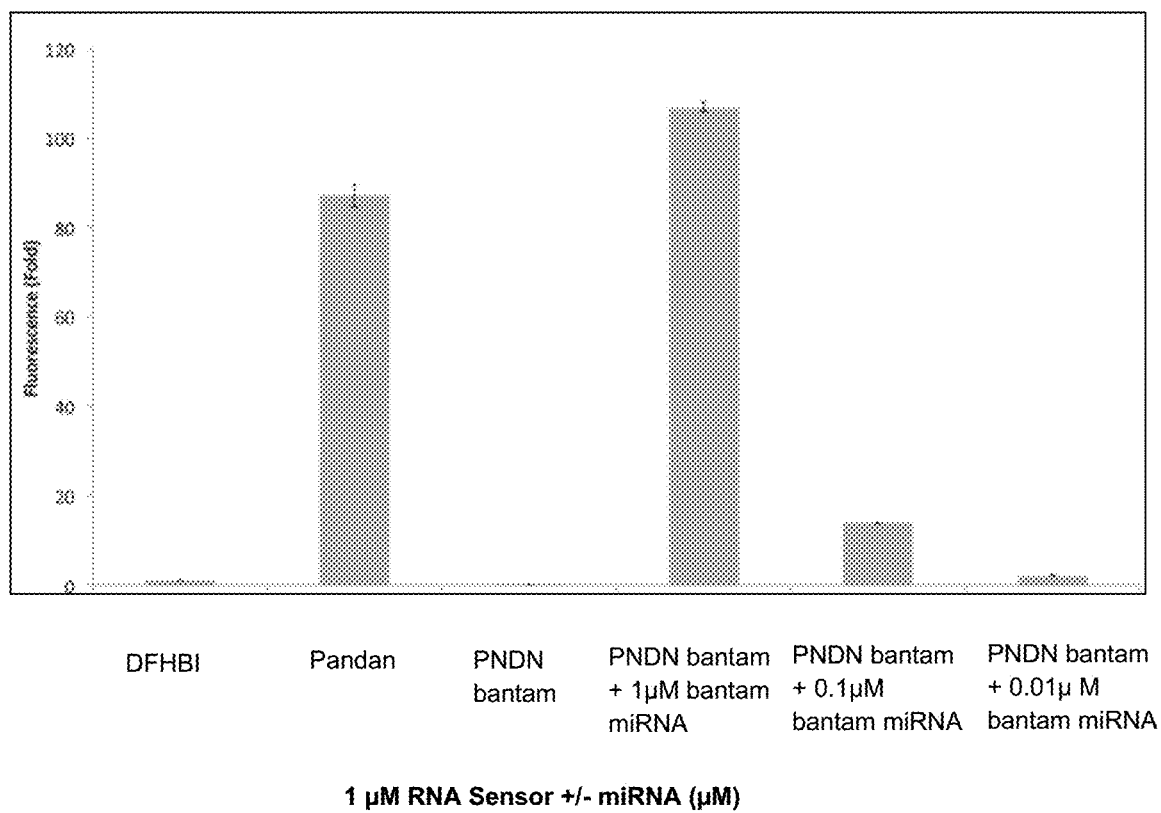

FIG. 2 shows a bar chart of the fluorescence levels of 1 µM Pandan bantam-5p miRNA sensor used with different miRNA samples. The y-axis represents the fold increase in the fluorescence level as compared to the DFHBI only control. The bars represent, from left to right, the following experimental setups: DFHBI alone (negative control); Pandan (positive control); Pandan bantam-5p miRNA sensor+ DFHBI; Pandan bantam-5p miRNA sensor+DFHBI+1 µM bantam-5p miRNA; Pandan bantam-5p miRNA sensor+ DFHBI+0.1 µM bantam-5p miRNA; Pandan bantam-5p miRNA sensor+DFHBI+0.01 µM bantam-5p miRNA. The positive control is a Pandan RNA molecule, with the bantam miRNA encoded with its cognate Pandan sensor as one continuous molecule. The sequence of the positive control thus consists of the Pandan sensor at the 5' end and the bantam miRNA at the 3'end. The results demonstrate that a significant fold increase in the fluorescence level of the Pandan bantam-5p miRNA sensor only occurs when the target bantam-5p miRNA is present in the sample, and the fold increase depends on the amount of target miRNA present in the sample.

FIG. 3A illustrates the structure of stem loop 3 (SL3) of an exemplary Pandan sensor, Pandan 263a, with (right panel) and without (left panel) an extension in the stem, and a bar chart of the fluorescence levels of 1 µM Pandan miR-263a sensor with or without an extension of the stem in SL3, used with different miRNA samples. The y-axis represents the fold increase in the fluorescence level as compared to the Pandan miR-263a sensor+DFHBI control. The pairs of bars represent, from left to right, the following experimental setups: Pandan miR-263a sensor alone; Pandan miR-263a sensor+DFHBI control (negative control); Pandan miR-263a sensor+DFHBI+1 µM miR-263a; Pandan miR-263a sensor+DFHBI+0.1 µM miR-263a; Pandan miR-263a sensor+DFHBI+0.01 µM miR-263a. The left bar in each pair represents the fluorescence level when the Pandan miR-263a sensor without the extension in SL3 is used, while the right bar in each pair represents the fluorescence level when the Pandan miR-263a sensor with the extension in SL3 is used. The results demonstrate that extending the stem loop in SL3 improves the strength of the Pandan sensor signal for the detection of miR-263a.

FIG. 3B illustrates the structure of stem loop 3 (SL3) of another exemplary Pandan sensor, Pandan bantam, with (right panel) and without (left panel) an extension in the stem, and a bar chart of the fluorescence levels of 1 µM Pandan bantam miRNA sensor with or without an extension of the stem in SL3, used with different miRNA samples. The y-axis represents the fold increase in the fluorescence level as compared to the Pandan bantam miRNA sensor+DFHBI control. The pairs of bars represent, from left to right, the following experimental setups: Pandan bantam sensor+ DFHBI control (negative control); Pandan bantam sensor+ DFHBI+1 µM bantam miRNA; Pandan bantam sensor+ DFHBI+0.1 µM bantam miRNA; Pandan bantam sensor+ DFHBI+0.01 µM bantam miRNA. The left bar in each pair represents the fluorescence level when the Pandan bantam miRNA sensor without the extension in SL3 is used, while the right bar in each pair represents the fluorescence level when the Pandan bantam miRNA sensor with the extension in SL3 is used. The results demonstrate that extending the stem loop in SL3 improves the strength of the Pandan sensor signal for the detection of bantam miRNA.

FIG. 3C illustrates the structure of stem loop 3 (SL3) of another exemplary Pandan sensor, Pandan miR1000, with (right panel) and without (left panel) an extension in the stem, and a bar chart of the fluorescence levels of 1 µM Pandan miR1000 sensor with or without an extension of the stem in SL3, used with different miRNA samples. The y-axis represents the fold increase in the fluorescence level as compared to the Pandan miR-1000 sensor+DFHBI control. The pairs of bars represent, from left to right, the following experimental setups: Pandan miR-1000 sensor alone; Pandan miR-1000 sensor+DFHBI control (negative control); Pandan miR-1000 sensor+DFHBI+104 miR-1000; Pandan miR-1000 sensor+DFHBI+0.1 µM miR-1000; Pandan miR-1000 sensor+DFHBI+0.01 µM miR-1000. The left bar in each pair represents the fluorescence level when the Pandan miR-1000 sensor without the extension in SL3 is used, while the right bar in each pair represents the fluorescence level when the Pandan miR-1000 sensor with the extension in SL3 is used. The results demonstrate that extending the stem loop in SL3 improves the strength of the Pandan sensor signal for the detection of miR1000.

FIG. 3D shows a bar chart of the fluorescence levels of 1 µM Pandan sensor with different extension lengths of the stem in SL3, used with 1 µM of different miRNA samples. The y-axis represents the fold increase in the fluorescence level as compared to the respective Pandan sensor without any extension in SL3 used with the same miRNA sample. The groups of bars represent, from left to right, the following experimental setups: Pandan miR-1000 sensor+104 miR-1000; Pandan miR-263a sensor+1 µM miR-263a; Pandan bantam-5p sensor+1 µM bantam-5p. The left bar in each group represents the fluorescence level when the Pandan sensor used has an extended 6 nucleotides-long stem in SL3. The middle bar in each group represents the fluorescence level when the Pandan sensor used has an extended 9 nucleotides-long stem in SL3. The right bar in each group represents the fluorescence level when the Pandan sensor used has an extended 12 nucleotides-long stem in SL3. The results demonstrate that further extensions of the stem in SL3 beyond 6 nucleotides long do not further improve the Pandan sensor signal.

FIG. 3E shows a bar chart of the fluorescence levels of 1 µM Pandan sensor with different extension lengths of the stem in stem loop 4 (SL4), used with 1 µM of bantam-3p miRNA. The y-axis represents the fold increase in the fluorescence level as compared to the respective Pandan sensor without any extension in SL4. The groups of bars represent, from left to right, the following experimental setups: Pandan bantam-3p sensor+DFHBI only (negative control); Pandan bantam-3p sensor+DFHBI+1 µM bantam-3p miRNA. The left bar in each group represents the fluorescence level when the Pandan sensor used has an extended 7 nucleotides-long stem in SL4. The middle bar in each group represents the fluorescence level when the Pandan sensor used has an extended 10 nucleotides-long stem in SL4. The right bar in each group represents the fluorescence level when the Pandan sensor used has an extended 13 nucleotides-long stem in SL4. The results demonstrate that extending the stem loop in SL4 does not improve the strength of the Pandan sensor signal.

FIG. 3F shows a bar chart of the fluorescence levels of 1 μM of different Pandan sensor with extension length of 6 nucleotides in the stem of SL3, used with 1 μM of different miRNA samples. The y-axis represents the fold increase in the fluorescence level as compared to the respective Pandan sensor with DFHBI (negative control). The groups of bars represent, from left to right, the following experimental setups: Pandan sensor+DFHBI; Pandan sensor+DFHBI+1 μM dme miRNA. The first bar in each group represents the fluorescence level when a Pandan sensor targeting dme miRNA124 is used. The second bar in each group represents the fluorescence level when a Pandan sensor targeting dme miRNA14 is used. The third bar in each group represents the fluorescence level when a Pandan sensor targeting dme miRNA1 is used. The fourth bar in each group represents the fluorescence level when a Pandan sensor targeting dme miRNA184 is used. The fifth bar in each group represents the fluorescence level when a Pandan sensor targeting dme miRNA252 is used. The results demonstrate that extending the stem loop in SL3 improves the strength of the Pandan sensor signal for the detection of *drosophila* miRNAs.

Figure 4:
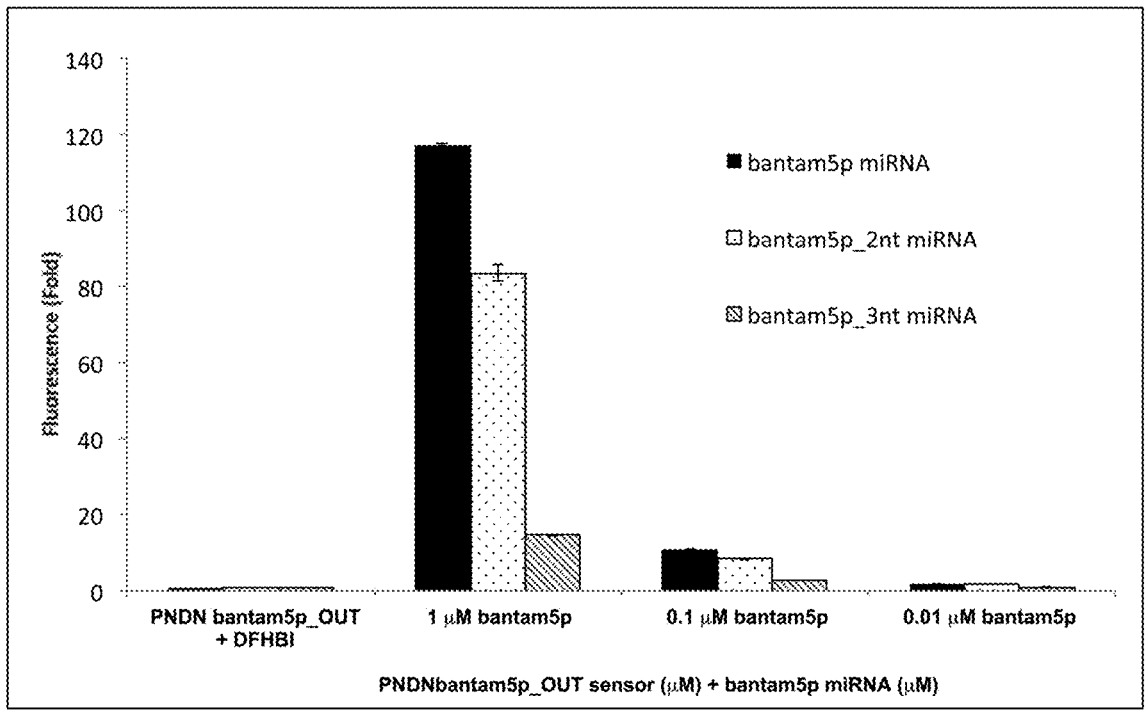

FIG. 4A shows a bar chart of the fluorescence levels of 1 μM Pandan bantam-5p miRNA sensor used with different miRNA samples. The y-axis represents the fold increase in the fluorescence level as compared to the Pandan bantam-5p miRNA sensor+DFHBI control. The groups of bars represent, from left to right, the following experimental setups: Pandan bantam-5p miRNA sensor+DFHBI control (negative control); Pandan bantam-5p miRNA sensor+DFHBI+1 μM bantam-5p miRNA; Pandan bantam-5p miRNA sensor+DFHBI+0.104 bantam-5p miRNA; Pandan bantam-5p miRNA sensor+DFHBI+0.01 μM bantam-5p miRNA. The left bar in each group represents the fluorescence level when the synthesized target bantam-5p miRNA is used. The middle bar in each group represents the fluorescence level when the bantam-5p miRNA with two nucleotides mutation is used. The right bar in each group represents the fluorescence level when the bantam-5p miRNA with three nucleotides mutation is used. The results demonstrate that the Pandan bantam-5p miRNA sensor can strongly differentiate between the target bantam-5p miRNA and the bantam-5p miRNA with mutations. The sequences of the bantam-5p miRNA with and without mutations are listed in FIG. 4B.

FIG. 5A shows a bar chart of the fluorescence levels of 1 μM Pandan snoR442 sensor used with RNA samples with different amount of snoR442 small RNAs. The y-axis represents the fold increase in the fluorescence level as compared to the Pandan snoR442 sensor+DFHBI control. The groups of bars represent, from left to right, the following experimental setups: Pandan snoR442 sensor+DFHBI control (negative control); Pandan snoR442 sensor+DFHBI+1 μM snoR442 small RNA; Pandan snoR442 sensor+DFHBI+0.1 μM snoR442 small RNA; Pandan snoR442 sensor+DFHBI+0.01 μM snoR442 small RNA. The left bar in each group represents the fluorescence level when a Pandan sensor targeting part 1 of snoR442 small RNA is used. The middle bar in each group represents the fluorescence level when a Pandan sensor targeting part 2 of snoR442 small RNA is used. The right bar in each group represents the fluorescence level when both Pandan sensors targeting part 1 and part 2 of snoR442 small RNA are used in equal amount. The results demonstrate that Pandan sensors designed against each half of the snoR442 miRNA can be used to detect full length snoR442, and that these two Pandan sensors can be used in combination to increase the overall signal derived from the same amount of the target snoR442 miRNA. The sequences of full length snoR442 miRNA as well as the first and second half of the snoR442 miRNA are listed in FIG. 5B.

Figure 6:
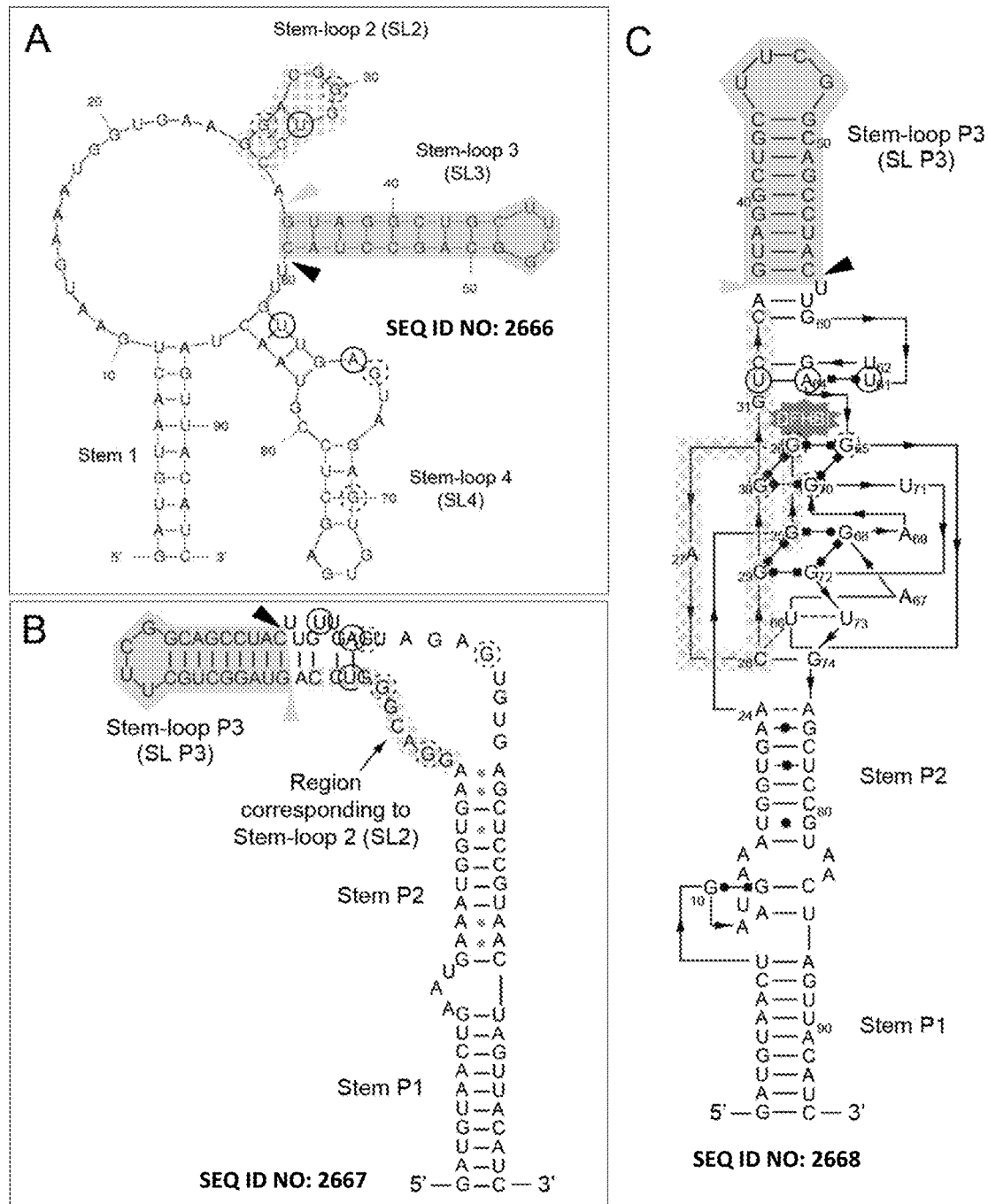

FIG. 6 illustrates Pandan structure and sensor design strategy. FIG. 6A represents the computationally (mFold) predicted structure of the Spinach sensor. FIG. 6B is a simplified 2D representation of the solved crystal structure of Spinach2 sensor. FIG. 6C is a detailed 2D representation of the solved crystal structure of Spinach2 sensor. As the helices were differently named in the two solved structures, for consistency, the paired regions are named P1, P2 and P3. Dashed circled Gs form the top tetrad of the core G-quadruplex region and solid circles highlight the bases in the base triple that is required for Spinach folding. Solid grey shading highlight the bases in each structure that correspond to Stem-loop P3, and checkered grey shading highlight the bases in each structure that correspond to Stem-loop 2 of the predicted structure in FIG. 6A. The grey arrowhead in each structure indicates the position where SL P3 5' was inserted, and the black arrowhead indicates the position where SL P3 3' was inserted (See FIG. 7). Adding another stem loop (stem-loop P4, as shown in FIG. 8) to Spinach2 allows the new molecule to function as a sequence-specific sensor.

Figure 7:
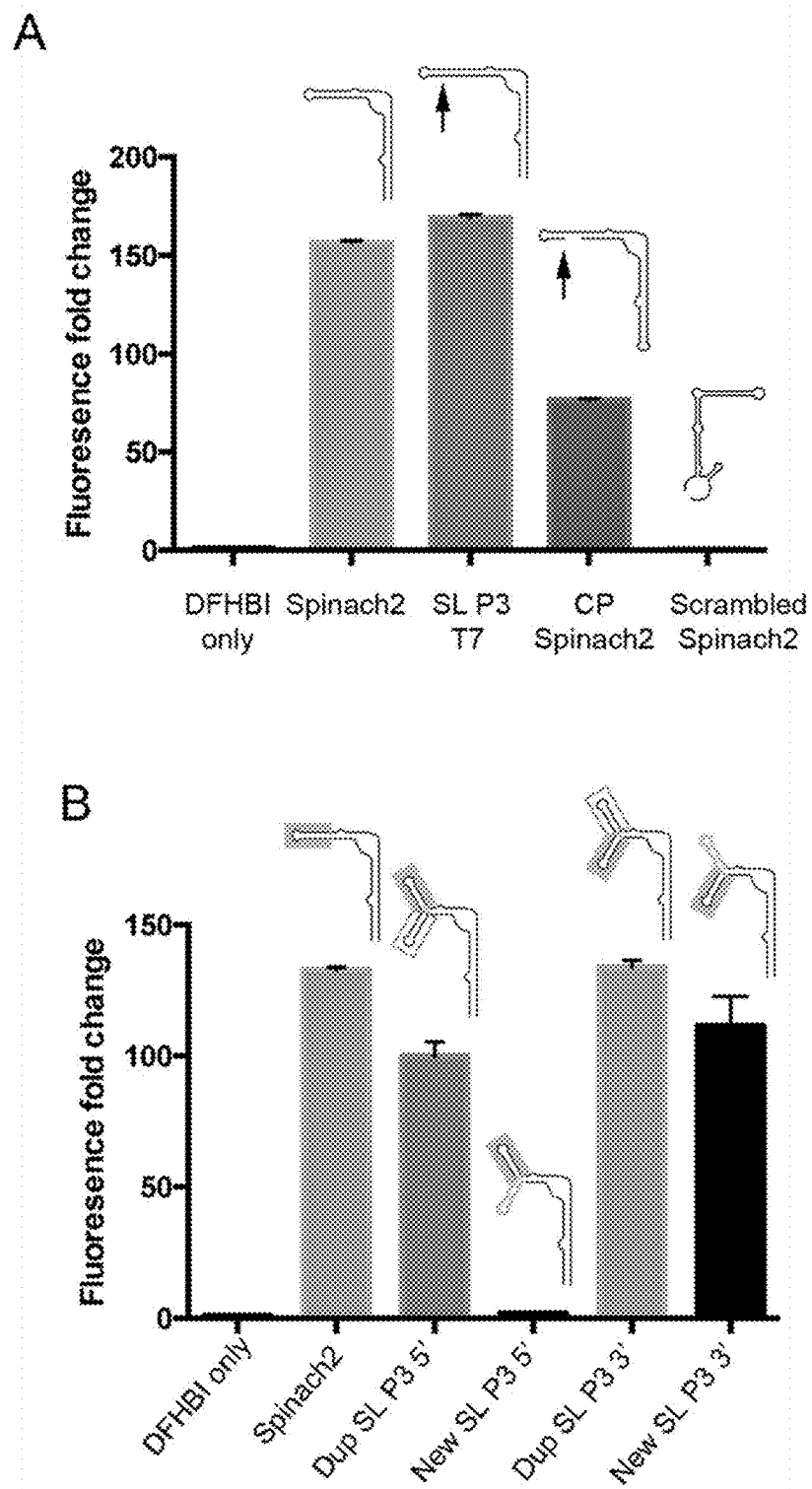

FIG. 7 illustrates features of the Pandan sensor design. FIG. 7A shows fluorescence intensity fold change of DFHBI+Spinach2 and modified versions of Spinach2 compared to the DHFBI-only control. All samples contained DFHBI. Schematic structures of the different RNAs are shown. Arrows indicate the position of the inserted partial T7 transcriptional start site, GGGA. FIG. 7B shows fluorescence intensity fold change of sensor designs testing the addition of extra adjacent stem-loop sequences 5' and 3' of SL P3 (positions indicated in arrowheads in FIG. 6A to C. Dup SL P3 indicates insertion of a second copy of the SL P3 stem-loop. New SL indicates insertion of an independent randomly chosen sequence of the same length. All samples contained DFHBI.

Figure 8:
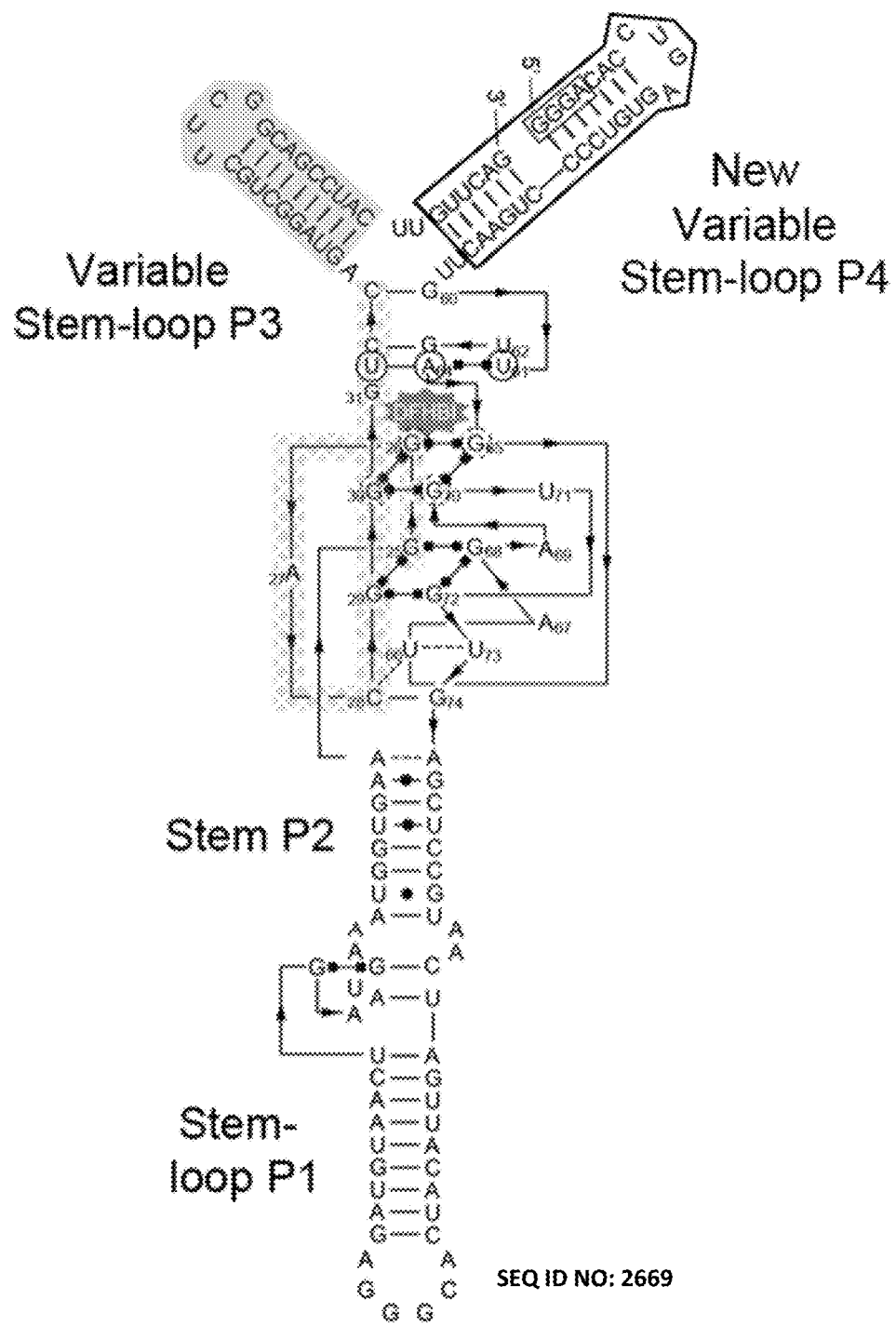

FIG. 8 is a diagram showing the single-molecule version of Pandan with the 5' and 3' ends in the added stem-loop P4. The addition of the new stemloop P4 allows it to act as a sensor for the detection of the target RNA. Shading is consistent with FIG. 6A to C. The GGGA partial transcriptional start site is boxed. SL P3: Stem-loop P3; SL P3 T7: Spinach2 with an additional GGGA partial T7 transcriptional start site in SLP3; CP Spinach2: circularly permuted (CP) Spinach2. Fluorescence intensity fold change shown is with respect to DFHBI-only controls. Cartoons used in FIGS. 7A and 7B are based on the simplified 2D structure as shown in FIG. 6B.

Figure 9:
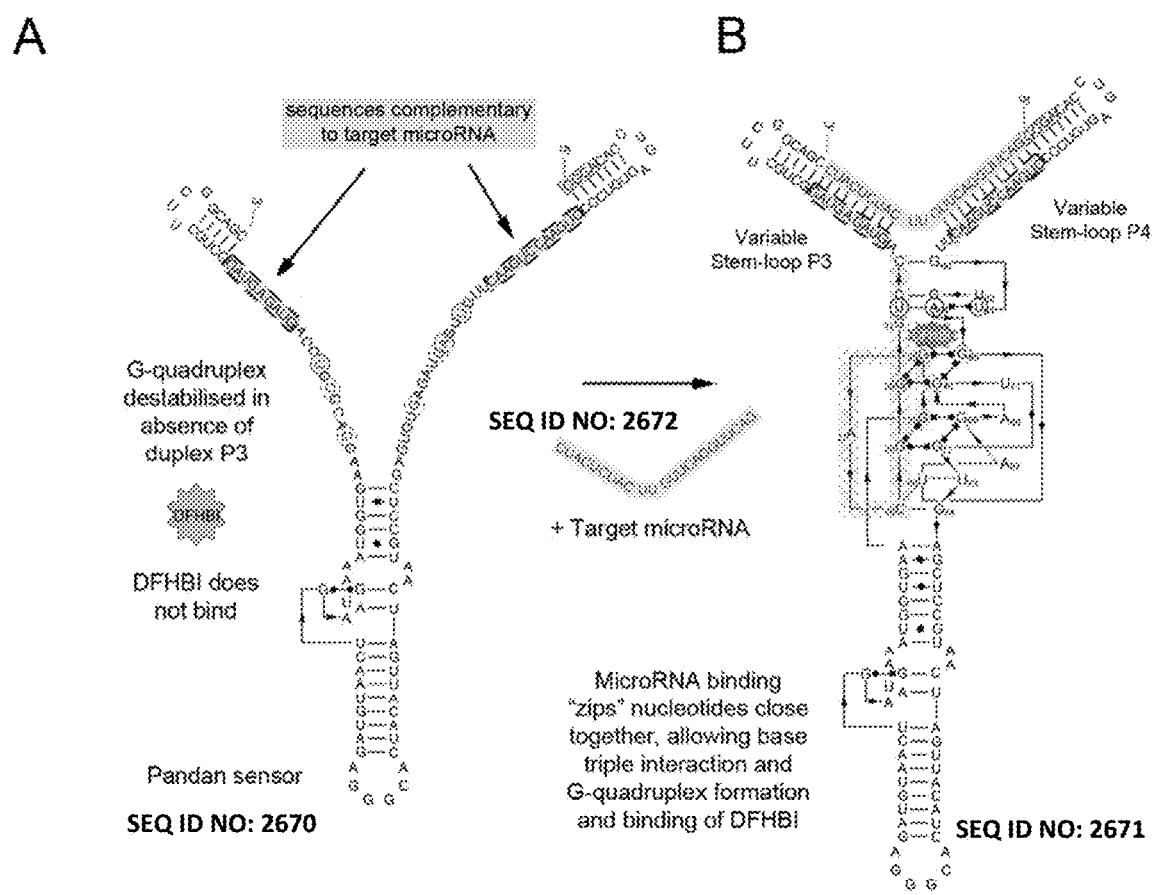

FIG. 9 demonstrates that Pandan is a bimolecular miRNA sensor. FIG. 9A illustrates that absence of the target miRNA prevents duplexes P3 and P4 from forming, hence destabilizing the G-quadruplex and base triplet required for proper folding and binding of DFHBI. FIG. 9B shows that pairing between miRNA and sensor backbone in stem-loops P3 and P4 allows for stable complex folding with DFHBI. The arrow indicates the second unpaired Uracil (U) 3' of SL P3, 5' of SL P4. The GGGA partial transcriptional start site is boxed. Shading is consistent with FIGS. 6A to C. The target miRNA is shaded in solid grey. Sequences complementary to the target miRNA are in dashed boxes.

Figure 10:
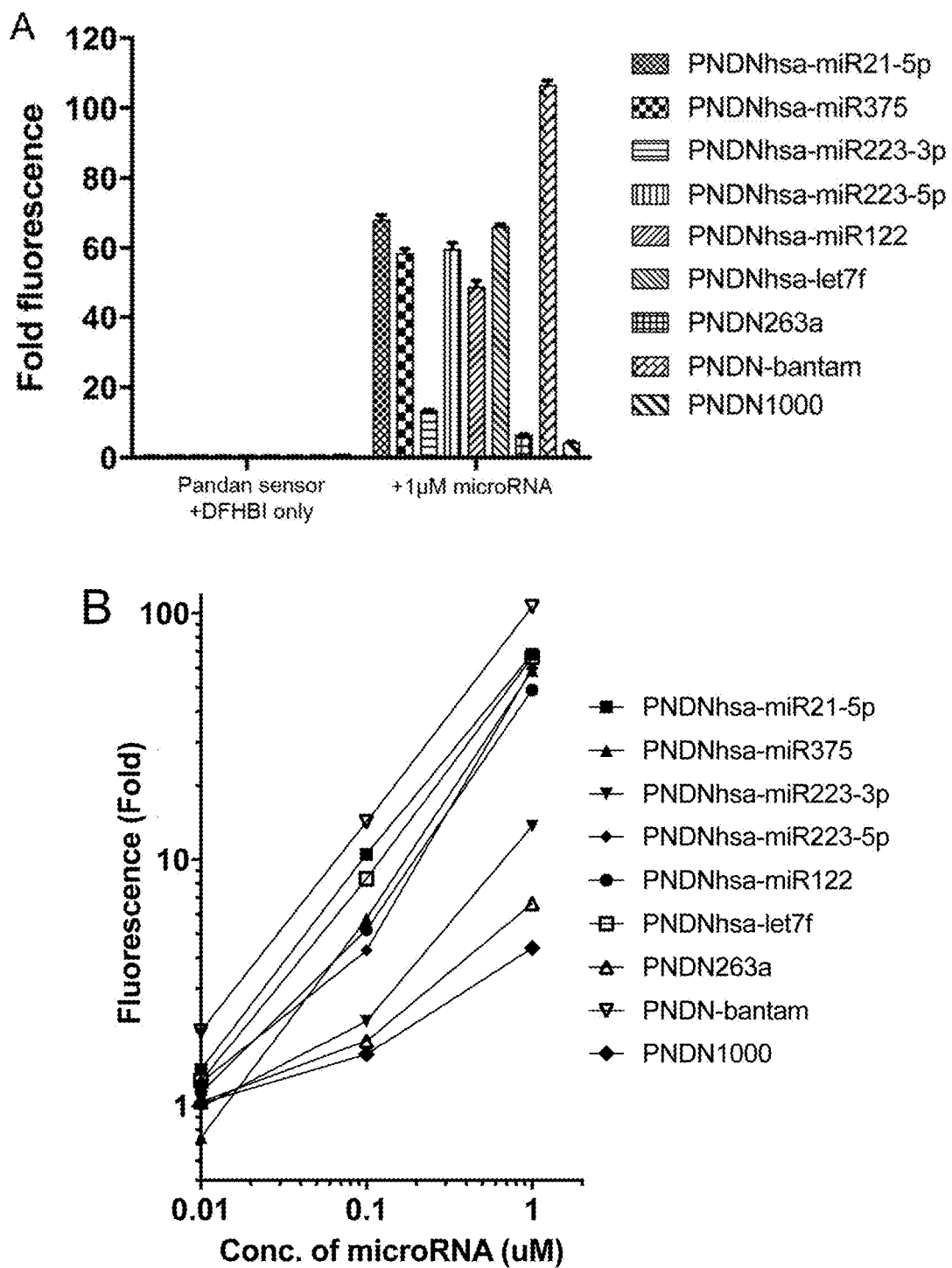

FIG. 10 illustrates sequence-specific miRNA detection by Pandan sensors. FIG. 10A shows fluorescence intensity fold change of Pandan sensors for several different miRNAs compared to each respective sensor+DFHBI alone. FIG. 10B shows fluorescence intensity fold change of Pandan sensors as a function of miRNA concentration for miRNAs from FIG. 10A. All samples contained DFHBI. FIG. 10C shows fluorescence intensity fold change of 1 μM bantam-5p Pandan sensor in the absence or presence of 1 μM bantam-5p miRNA, compared to that of 1 μM Spinach2, 1 μM CP Spinach2 and 1 μM Pandan bantam-5p-IN (where the sequence of bantam-5p miRNA is encoded into Pandan as one continuous molecule). Fluorescence intensity fold change shown is with respect to DFHBI-only controls. All samples contained DFHBI.

Figure 11:
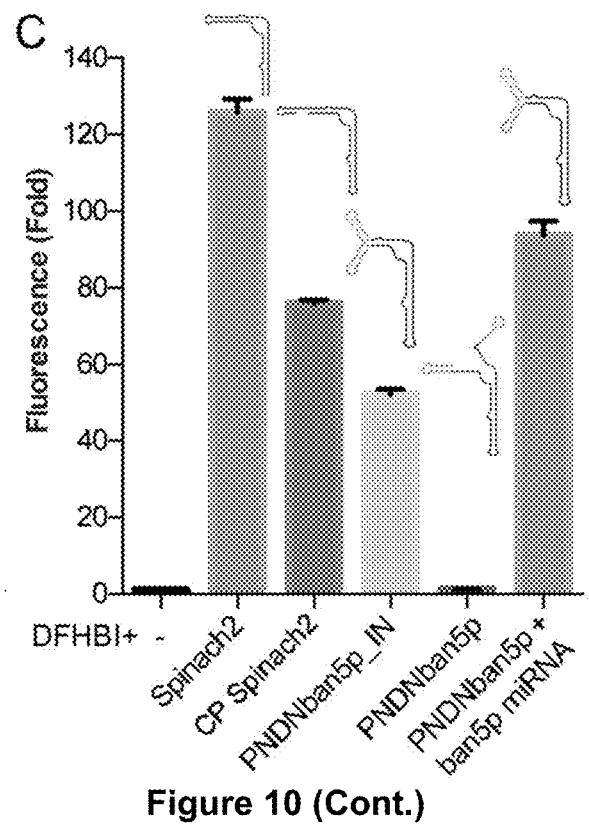
Figure 11:
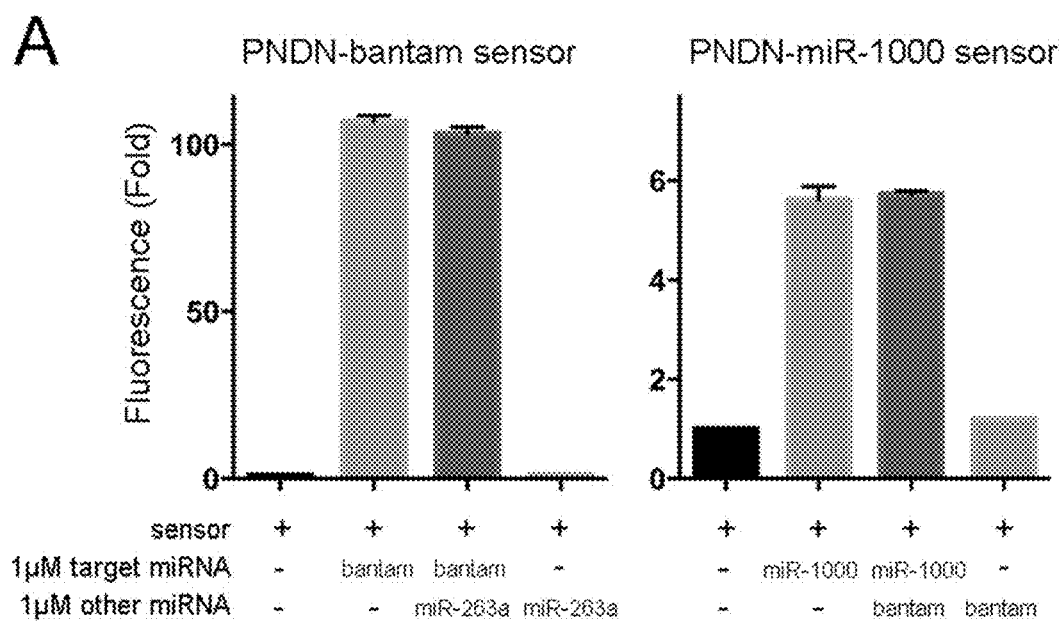
Figure 11:
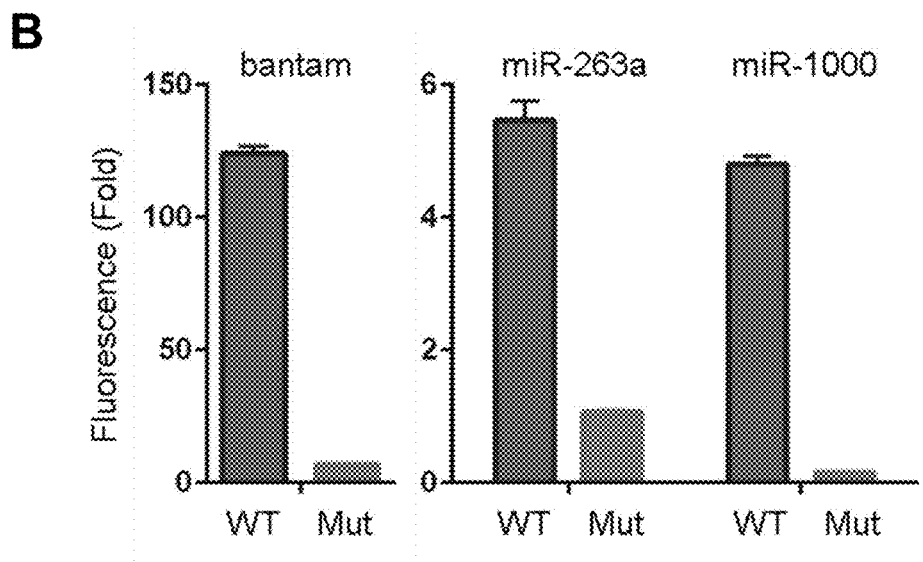
Figure 11:
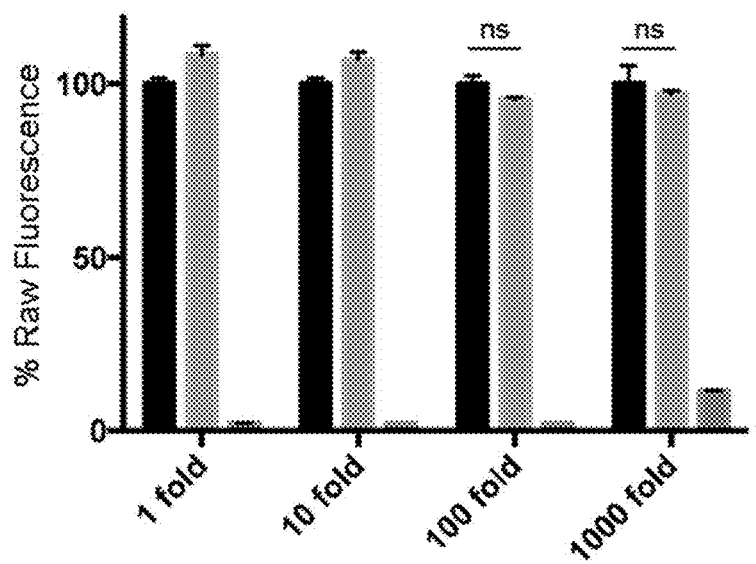

FIG. 11 demonstrates the parameters affecting the selectivity of Pandan sensors. FIG. 11A shows fluorescence intensity fold change of Pandan sensors for bantam-5p and miR-1000 miRNAs tested with target and non-target miRNAs. FIGS. 11B and 11C show fluorescence intensity of Pandan sensors for bantam-5p, miR-263a and miR-1000 miRNAs tested with perfectly complementarity and sequence modified miRNAs. FIG. 11B shows the effect of mutating three residues in the miRNA 5' end. FIG. 11C shows the effects of single residue mutations at different positions in the miRNA. Sequence changes are underlined. FIG. 11D shows the performance of the bantam-3p Pandan sensor with increasing fold excess of competing *Drosophila* total RNA, expressed as a percentage of raw fluorescence of sensor with bantam-3p in the absence of competing RNA. The presence of up to 1000-fold of competing RNA did not decrease the ability of bantam-3p sensor to detect bantam-3p ($P>0.05$). Fluorescence intensity fold change shown is with respect to sensor+DFHBI-only controls (negative control without miRNA). All samples contained DFHBI.

Figure 12:
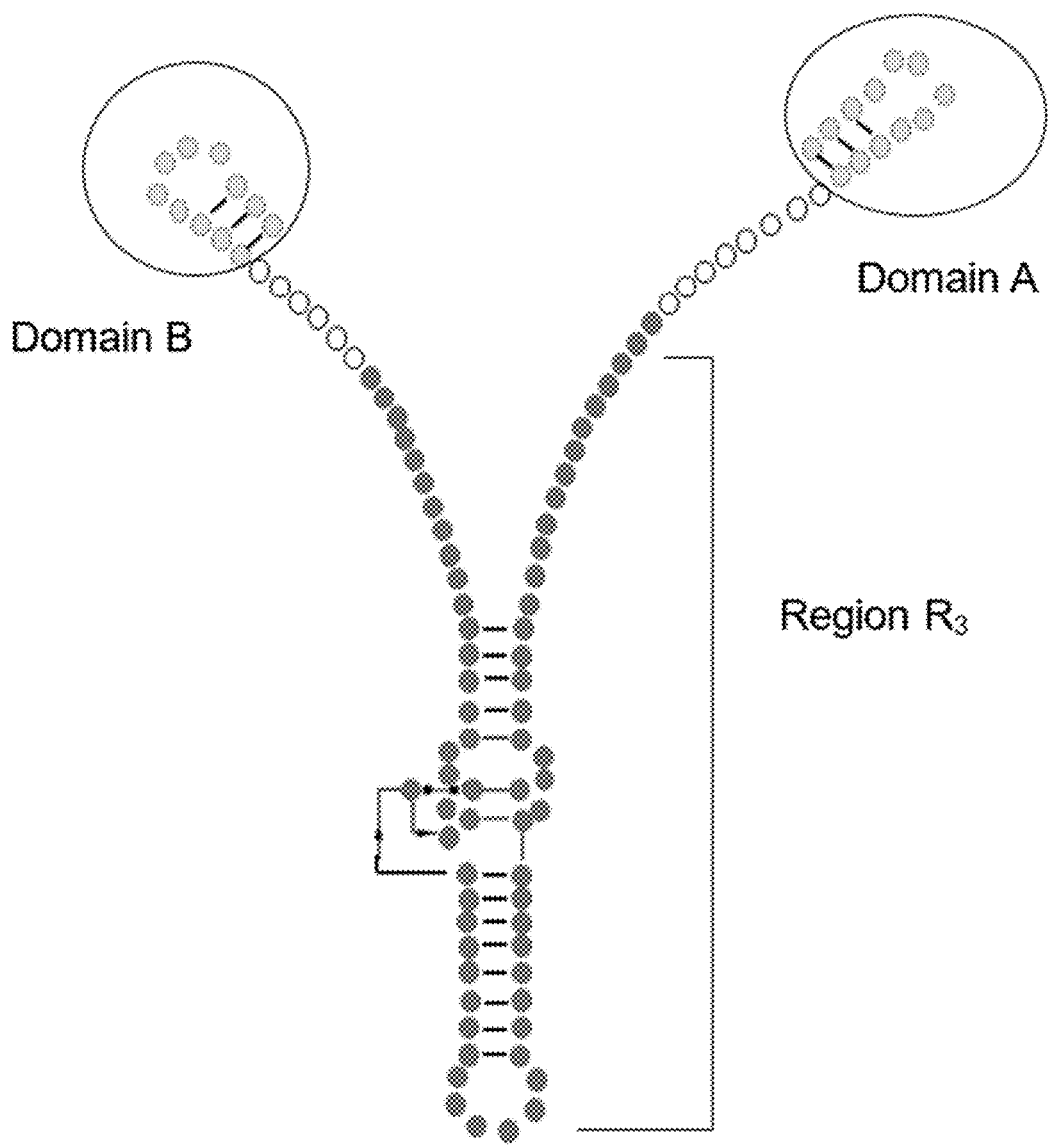

FIG. 12 shows a schematic representation of the structure of a Pandan aptamer before the target nucleic acid sequence is bound. Region R3 represents the core structure (solid circles represent the nucleotides in R3), $C_1$ and $C_2$ represent the variable domains which complementarily bind to the 5' and 3' ends of the target nucleic acid sequence (circles represent the nucleotides in $C_1$ and $C_2$). Domains A and B represent the variable domains that could form stabilizing secondary structures (dashed circles represent the nucleotides in Domains A and B). The schematic representation is an illustration of the structure only, the number of circles in each region and domain does not necessarily represent the exact number of nucleotides in each region and domain.

Figure 13:
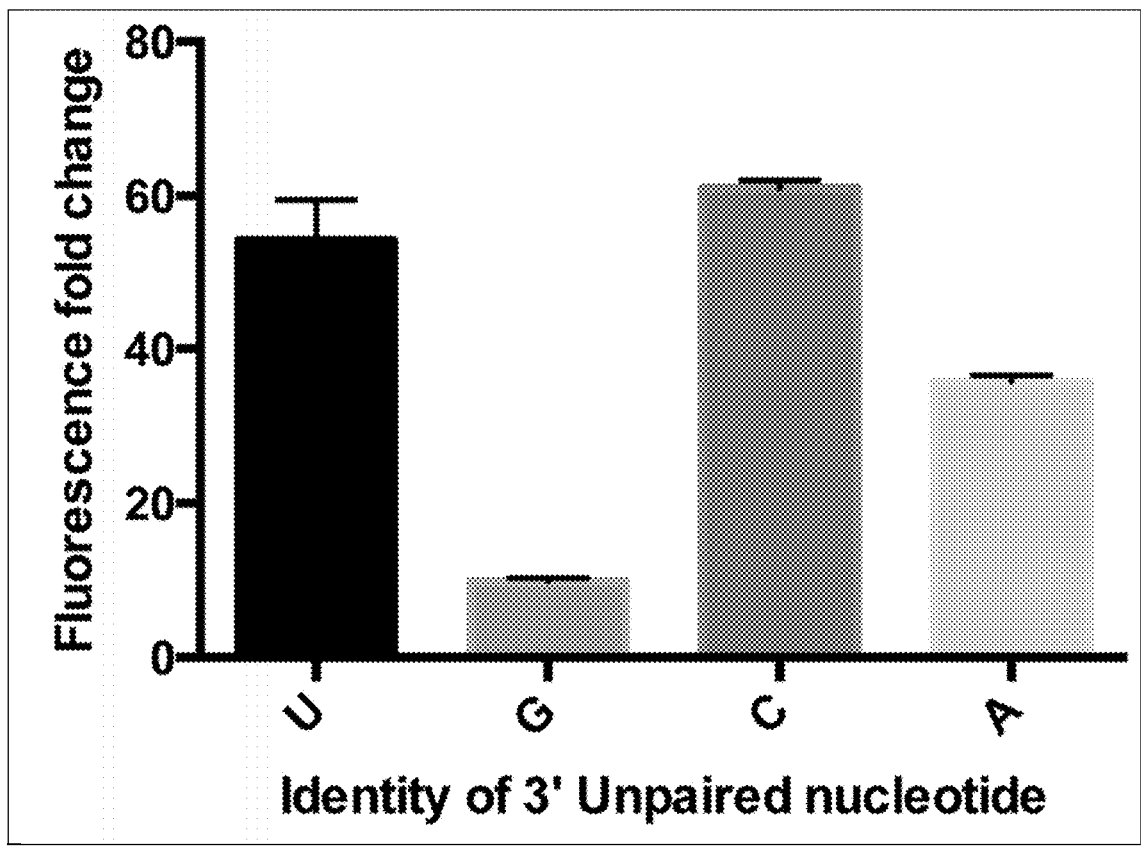

FIG. 13 shows a bar chart of the fluorescence levels of Pandan bantam-3p sensor used with bantam-3p target miRNAs with different nucleotides in the middle unbound region of the target miRNA. The y-axis represents the fold increase in the fluorescence level as compared to the Pandan bantam-3p sensor+DFHBI control. The bars represent, from left to right, the following experimental setups: Pandan bantam-3p sensor+DFHBI+bantam-3p miRNA without mutation; Pandan bantam-3p sensor+DFHBI+bantam-3p miRNA with U to G mutation; Pandan bantam-3p sensor+DFHBI+bantam-3p miRNA with U to C mutation; Pandan bantam-3p sensor+DFHBI+bantam-3p miRNA with U to A mutation. The nucleotide sequences of the target miRNAs are presented in the table in FIG. 13. The two unpaired nucleotides in each target miRNA are underlined, and the sequence change of the 3' unpaired nucleotide is in bold. Binding with target miRNA having a cytosine (C) at the second unbound nucleotide position gives the Pandan sensor the highest fluorescence fold increase over the negative control (above 60 folds), following by uracil (U) (about 55 folds), followed by adenine (about 35 folds). Binding with target miRNA having a guanine (G) at the second unbound nucleotide position gives the Pandan sensor the lowest fluorescence fold increase over the negative control (about 10 folds). The results demonstrate that the sensor can function regardless of the identity of the second unbound nucleotide in the unbound region of the target miRNA. (Comment: FIG. 13 shows that fluorescence is even better when the nucleotide is a C and pretty good when it is an A. Even when it is a G, there is still 10 fold fluorescence change. However, this one example is not sufficient to extrapolate as it could be context dependent. It merely shows that that nucleotide is not restricted to a Uracil (even though all the sensors we designed have a Uracil is that position as you can see from the sequences we provided).

DETAILED DESCRIPTION OF THE PRESENT INVENTION

The present invention provides a simple one-step molecular system for the detection of miRNA.

In a first aspect, the present invention refers to an isolated nucleic acid sequence for detecting the presence of a target nucleic acid sequence, wherein the isolated nucleic acid sequence is capable of forming bimolecular interactions with the target nucleic acid sequence, wherein the isolated nucleic acid sequence forms a ternary complex stabilising a detection agent when binding the target nucleic acid sequence and wherein the isolated nucleic acid sequence comprises the following structure:

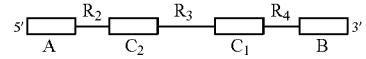

wherein A and B are domains forming stabilizing secondary structures, wherein $C_1$ and $C_2$ are domains that bind to the target nucleic acid sequence, wherein $R_2$ and $R_4$ are regions of nucleic acids that do not bind with the target nucleic acid sequence, and wherein $R_3$ is a region of nucleic acids capable of stabilising a detection agent upon the isolated nucleic acid binding to the target nucleic acid sequence.

The structure of the isolated nucleic acid sequence of the first aspect can further comprise regions $R_1$ and $R_5$, wherein $R_1$ is upstream from domain A and $R_5$ is downstream from domain B, and wherein $R_1$ and $R_5$ are regions of nucleic acids that do not bind with the target nucleic acid sequence and are capable of forming secondary structures.

The term "nucleic acid sequence" as used herein refers to a polymeric form of nucleotides. It may be in the form of RNA or single-stranded DNA, that comprise purine and pyrimidine bases, or other natural, chemically or biochemically modified, non-natural, or derivative nucleotide bases. References to single stranded nucleic acids include references to the sense or antisense strands. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. These analogs are those molecules having some structural features in common with a naturally occurring nucleoside or nucleotide such that when incorporated into a nucleic acid or oligonucleotide sequence, they allow hybridization with a naturally occurring nucleic acid sequence. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

The term "complementary" as used herein refers to a nucleotide or nucleotide sequence that hybridizes to a given nucleotide or nucleotide sequence. For instance, for RNA, the nucleotide A is complementary to the nucleotide U, and vice versa, and the nucleotide C is complementary to the nucleotide G, and vice versa. Complementary nucleotides include those that undergo Watson and Crick base pairing and those that base pair in alternative modes.

The term "isolated" as used herein means altered "by the hand of man" from its natural state, i.e., if it occurs in nature, it has been changed or removed from its original environment, or both. Thus, the term "isolated nucleic acid sequence" as used herein refers to a nucleic acid sequence which has been purified from the sequences which flank it in a naturally occurring state. It can also be used to refer to a synthesized nucleic acid sequence which does not exist in nature. In some examples, the term "isolated nucleic acid sequence" and "synthesized nucleic acid sequence" can be used interchangeably.

The term "target nucleic acid sequence" as used herein refers to the nucleic acid sequence of interest that is to be detected using the molecular sensor system of the present invention. The molecular sensor system includes the molecular sensor which is the isolated nucleic acid sequence of the first aspect. The target nucleic acid sequence can be a single-stranded nucleic acid sequence or double-stranded nucleic acid sequence. Preferably, it is a single-stranded nucleic acid sequence. The nucleic acid sequence can be a deoxyribonucleic acid (DNA) sequence or a ribonucleic acid (RNA) sequence. Preferably, it is an RNA sequence. Examples of RNA sequences include but are not limited to, microRNA (miRNA), short interfering RNA (siRNA), small RNA (sRNA), messenger RNA (mRNA), non-coding RNA (ncRNA), transfer RNA (tRNA), ribosomal RNA (rRNA), transfer-messenger RNA (tmRNA), clustered regularly interspaced short palindromic repeats RNA (CRIPSR RNA), antisense RNA, pre-mRNA and pre-miRNA. In one specific example, the RNA sequence is a miRNA sequence.

The term "microRNA" (abbreviated miRNA) as used herein refers to a small non-coding RNA molecule. It generally functions in RNA silencing and post-transcription regulation of gene expression. While the majority of miRNAs are located within the cell, some miRNAs, commonly known as circulating miRNAs or extracellular miRNAs, have also been found in extracellular environment, including various biological fluids and cell culture media. In some examples, the length of the miRNAs can be between 10 to 12, or between 12 to 14, or between 14 to 16, or between 16 to 18, or between 18 to 20, or between 20 to 22, or between 22 to 24, or between 24 to 26, or between 26 to 28, or between 28 to 30, or 11, 13, 15, 17, 19, 21, 23, 25, 27, or 29 nucleotides long.

The terms "domain" and "region" as used herein refer to different sections of the linear nucleic acid sequence of the isolated nucleic acid sequence of the first aspect. Domain refers to sections that either have direct interaction with the target nucleic acid sequence or the detection agent. Regions, on the other hand, are sections of the linear nucleic acid sequence that are not known to directly interact with either the target nucleic acid sequence or the detection agent before the target nucleic acid sequence is bound. However, regions can be capable of stabilising a detection agent upon the isolated nucleic acid of the first aspect binding to the target nucleic acid sequence.

The term "secondary structure" of a nucleic acid molecule refers to the base-pairing interactions within a single molecule or set of interactive molecules, and can be represented as a list of bases which are paired in a nucleic acid molecule. The secondary structures of biological DNAs and RNAs tend to be different: biological DNA mostly exists as fully base-paired double helices, while biological RNA is single stranded and often forms complicated base-pairing interactions due to its increased ability to form hydrogen bonds stemming from the extra hydroxyl group in the ribose sugar. Examples for secondary structures of nucleic acids include, but are not limited to, single-nucleotide bulges, three-nucleotide bulges, stems, stem loops, t-RNA type structures, cloverleaves, tetraloops, pseudoknots, symmetrical internal loops, asymmetrical internal loops, three stem junctions, four stem junctions, two-stem junctions or coaxial stacks or combinations thereof. Specific examples of secondary structures include stems, stem loops, t-RNA type structures, cloverleaves, tetraloops, pseudoknots or combinations thereof.

As used herein, the term "stem loop", also known as a "hairpin loop", refers to a secondary nucleic acid structure that forms when two regions of the same strand, usually complementary in nucleotide sequence when read in opposite directions, base-pair to form a double helix that ends with an unpaired loop.

The term "ternary complex" as used herein refers to a complex containing three different molecules that are bound together. These three different molecules can be the isolated nucleic acid sequence of the first aspect, the target nucleic acid sequence that binds to the isolated nucleic acid sequence of the first, and the detection agent.

In some examples, domains A and B form stem loops. The lengths of the stems of the stem loops of domains A and B are independent from each other, and can be the same or different. For example, each of the stems of the stem loops of domains A and B can be between 1 to 5, or between 5 to 10, or between 10 to 15, or between 15 to 20, or 3, 4, 5, 6, 7, 8, 9, 10 nucleotides long. In some specific examples, each of the stems of the stem loops of domains A and B is 5 or 6 or 7 nucleotides long. In some specific examples, the stem of the stem loop of domain B is 6 nucleotides long.

In some examples, when the length of the stem of the stem loop of domain B increases from 3 nucleotides long to 4 nucleotides long, or from 4 nucleotides long to 5 nucleotides long, or from 5 nucleotides long to 6 nucleotides long, the signal strength of the sensor upon binding the target nucleic acid sequence will increase. In some examples, the signal strength is increased by 0.5 fold, 1 fold, 1.5 folds, 2 folds, 2.5 folds or 3 folds, or between 0.2 fold to 5 folds.

In some examples, the nucleotides of domains $C_1$ and $C_2$ complementarily bind to the opposite ends of the target nucleic acid sequence respectively. For example, domain $C_1$ can complementarily bind to the 5' end of the target nucleic acid sequence, while domain $C_2$ can complementarily bind to the 3' end of the target nucleic acid sequence, and vice versa. The complementary binding can be either partially complementary or fully complementary. For example, domain $C_1$ can be between about 70 to about 80%, or between about 80% to about 90%, or between about 90% to about 100%, or between about 75% to about 85%, or between about 85% to about 95%, or between about 95% to about 100%, or between about 88% to about 98%, or about 90%, about 91%, about 92%, about 93%, about 94%, about 95%, about 96%, about 97%, about 98%, about 99% or about 100% complementary to the 5' end of the target nucleic acid sequence; and domain $C_2$ can be between about 70 to about 80%, or between about 80% to about 90%, or between about 90% to about 100%, or between about 75% to about 85%, or between about 85% to about 95%, or between about 95% to about 100%, or between about 88% to about 98%, or about 90%, about 91%, about 92%, about 93%, about 94%, about 95%, about 96%, about 97%, about 98%, about 99% or about 100% complementary to the 3' end of the same target nucleic acid sequence, and vice versa. The lengths of domains $C_1$ and $C_2$ are independent from each other, and can be the same or different. For example, each of domains $C_1$ and $C_2$ can be between 3 to 5, or between 5 to 10, or between 10 to 15, or between 15 to 20, or between 20 to 30, or between 30 to 40, or between 40 to 50, or 3, 4, 5, 6, 7, 8, 9, 10 nucleotides long. In some specific examples, domain $C_1$ is 6 nucleotides long. In some other examples, domain $C_2$ is 8 nucleotides long.

In some examples, domain A can form a stem-loop. In some other examples, domain $C_2$ and the 3' end of the target nucleic acid sequence can complementarily bind to each other to form a stem. In some examples, (i) the stem-loop formed by domain A and (ii) the stem formed between domain $C_2$ and the 3' end of the target nucleic acid sequence together form a stem-loop. In some examples, this stem-loop formed by (i) and (ii) above is called stem-loop P4. The nucleic acid sequence of stem-loop P4 is variable, depending on the sequence of the target nucleic acid, and consequently the sequence of domain $C_2$. In some examples, all the isolated nucleic acid sequences of the first aspect comprise stem-loop P4.

In some examples, the target nucleic acid sequence to be detected does not fully bind to the isolated nucleic acid of the first aspect. A middle region of nucleic acids may be present between the 5' and the 3' ends of the target nucleic acid sequence, and the middle region does not bind to either domain $C_1$ or $C_2$. In some examples, the middle region can be between 1 to 2, or between 2 to 4, or between 4 to 6, or between 6 to 8, or between 8 to 10, or between 10 to 12, or between 12 to 14, or between 14 to 16, or between 16 to 18, or between 18 to 20, or 3, 5, 7, 9, 11, 13, 15, 17 or 19 nucleotides in length. In one specific example, the middle region is 2 nucleotides in length. In one specific example, the middle region comprises one uracil nucleotide. In some examples, the middle region comprises one uracil nucleotide and one nucleotide selected from: uracil, adenine, guanine and cytosine. In one specific example, the middle region comprises two uracil nucleotides. In one specific example, the middle region consists of two uracil nucleotides. In some other examples, the middle region does not comprise any uracil nucleotides.

In some examples, regions $R_2$ and/or $R_4$ are capable of forming secondary or linear structures. $R_2$ or $R_4$ can be between 0 to 20, or between 1 to 5, or between 5 to 10, or between 10 to 15, or between 15 to 20, or between 4 to 7, or between 8 to 15, or between 15 to 20 nucleotides in length. In some examples, $R_2$ or $R_4$ is absent. In some examples, both $R_2$ and $R_4$ are absent. When $R_2$ is absent, domain A is directly linked to domain $C_2$. When $R_4$ is absent, domain B is directly linked to domain $C_1$. Preferably, the regions $R_2$ and $R_4$ do not interfere with interactions of the domains of the isolated nucleic acid sequence of the first aspect.

In some examples, region $R_1$ or $R_5$ is between 0 to 20, or between 1 to 5, or between 5 to 10, or between 10 to 15, or between 15 to 20, or between 4 to 7, or between 8 to 15, or between 15 to 20 nucleotides in length. Preferably, the regions $R_1$ and $R_5$ do not interfere with interactions of the domains of the isolated nucleic acid sequence of the first aspect.

In some examples, the region $R_3$ is between 0 to 100, or between 1 to 5, or between 5 to 10, or between 10 to 15, or between 15 to 20, or between 20 to 30, or between 30 to 40, or between 40 to 50, or between 50 to 60, or between 60 to 70, or between 70 to 80, or between 80 to 90, or between 90 to 100 nucleotides in length.

Preferably, the target nucleic acid sequence is competitively bound to the isolated nucleic acid sequence of the first aspect.

In some examples, region $R_3$ can further comprise defined domains and regions. In some examples, the isolated nucleic acid sequence of the first aspect can also have the following structure:

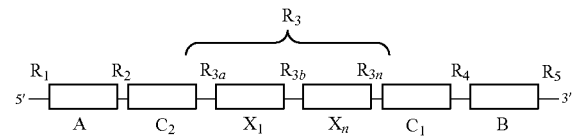

wherein $X_1$ to $X_n$ are domains containing nucleic acids that interact with the detection agent in a ternary complex and wherein $X_n$ denotes a variable number of domains, and wherein $R_1$ to $R_5$ are as previously defined and wherein $R_{3a}$ and $R_{3b}$ to $R_{3n}$ are the regions between the domains $C_2$ and $X_1$, $X_1$ to $X_n$, and $X_n$ and $C_1$ respectively, wherein $R_{3n}$ denotes a variable number of regions according to the number of $X_n$ domains present.

In some examples, the total number of domains $X_n$ can be 2, 3, 4, 5, 6, 7, 8, 9 or 10. The maximum number of domains $N_n$ present in the isolated nucleic acid sequence is the total number of nucleotides within the domains $X_n$ that interact with the detection agent in a ternary complex. In some examples, each of domains $X_1$ to $X_n$ is between 1 to 5, or between 5 to 10, or between 10 to 15, or between 15 to 20, or between 4 to 7, or between 8 to 15, or between 10 to 18, or 6, 7, 9, 10, 11, 12, 13, 14, 15, 16, 17, 18, 19, 20, 21, 22, 23, 24, 25 nucleotides in length. The length of each of domains $X_1$ to $X_n$ is independent, and can be the same or different from each other.

Region $R_3$ is capable of stabilising a detection agent once the isolated nucleic acid sequence of the first aspect binds to the target nucleic acid sequence.

The term "detection agent" as used herein refers to a substance that is capable of producing a detectable signal once being activated. A detection agent can be a chemical compound or a macromolecule, and it can be activated upon sensing its target analyte. Examples of such detection agents include but are not limited to fluorophore, chromophore, photophore, pigment and chromatophore.

The term "fluorophore" as used herein refers to a fluorescent chemical compound that can re-emit light upon light excitation. Fluorophores typically contain several combined aromatic groups, or planar or cyclic molecules with several π bonds. Although sometimes being used alone, fluorophores are more generally covalently bonded to a macromolecule. Examples of fluorophore include but are not limited to 4-(3,4,5-trimethoxybenzylidene)-1,2-dimethylimidazol-5-one ("TMBI"); 4-(4-hydroxy-3,5-dimethoxy-benzylidene)-1,2-dimethyl-imidazol-5-one ("DMHBI"); difluoro-4-hydroxybenzylidene)-1,2-dimethyl-imidazol-5-one ("DFHBI"); (E)-4-(3,5-difluoro-4-hydroxybenzylidene)-1-methyl-5-oxo-4,5-dihydro-1H-imidazole-2-carbaldehyde O-methyl oxime ("DFHBI-methyloxime"); 4-(3,5-dichloro-4-hydroxybenzylidene)-1,2-dimethyl-imidazol-5-one; 4-(3,5-dibromo-4-hydroxybenzylidene)-1,2-dimethyl-imidazol-5-one; 4-(2-hydroxybenzylidene)-1,2-dimethyl-imidazol-5-one ("o-HBI"); 4-(2-methoxybenzylidene)-1,2-dimethyl-imidazol-5-one; 4-(3-fluoro-4-hydroxy-5-methoxybenzylidene)-1,2-dimethyl-imidazol-5-one; 4-(4-(dimethylamino)benzylidene)-1,2-dimethyl-imidazol-5-one ("DMABI"); 4-(4-(t-butylthio)benzylidene)-1,2-dimethyl-imidazol-5-one; 4-(4-(methylthio)benzylidene)-1,2-dimethyl-imidazol-5-one; 4-(4-cyanobenzylidene)-1,2-dimethyl-imidazol-5-one; 4-(3,5-difluoro-4-acetate)benzylidene-1,2-dimethyl-imidazol-5-one; 4-(4-hydroxy-3-nitrobenzylidene)-1,2-dimethyl-imidazol-5-one; 4-(4-hydr oxy-3-methoxy-5-nitrobenzylidene)-1,2-dimethyl-imidazol-5-one; 4-(4-methoxy-3-nitrobenzylidene)-1,2-dimethyl-imidazol-5-one; 4-(4-bromobenzylidene)-1,2-dimethyl-imidazol-5-one; 4-(4-chlorobenzylidene)-1,2-dimethyl-imidazol-5-one; 4-(4-hydroxybenzylidene)-1,2-dimethyl-imidazol-5-one ("p-HBI"); 4-((indol-7-yl)methylene)-1,2-dimethyl-imidazole-5-one; 4-((indol-3-yl)methylene)-1,2-dimethyl-imidazol-5-one; 4-((indol-3-yl)methylene)-1-methyl-2-phenyl-imidazole-5-one; 4-(4-hydroxy-3,5-dimethoxybenzylidene)-1-methyl-2-phenyl-imidazole-5-one; 4-(4-(dimethylamino)benzylidene)-1-methyl-2-phenyl-imidazole-5-one; 4-(4-hydroxybenzydene)-2-acetyl-1-methyl-imidazole-5-one; 4-(4-hydroxybenzylidene)-1-methyl-2-prop-1-enyl-imidazole-5-one; 3-(4-(4-hydroxybenzylidene)-4,5-dihydro-1-methyl-5-oxo-imidazol-2-yl)acrylamide; 3-(4-(4-hydroxybenzylidene)-4,5-dihydro-1-methyl-5-oxo-imidazol-2-yl)acrylic acid; methyl 3-(4-(4-hydroxybenzylidene)-4,5-dihydro-1-methyl-5-oxo-imidazol-2-yl)acrylate; 4-(3,5-difluoro-4-hydroxybenzylidene)-1-methyl-2-((E)-2-nitro vinyl)-1H-imidazol-5(4H)-one ("DFAN"); 4-(3-fluoro-4-hydroxy-5-methoxybenzylidene)-1-methyl-2-((E)-2-nitro vinyl)-1H-imidazol-5(4H)-one; 4-(3-fluoro-4-hydroxy-5-methoxybenzylidene)-1-methyl-5-oxo-4,5-dihydro imidazole-2-carbaldehyde O-methyl oxime; 4-(3-fluoro-4-hydroxy-5-methoxybenzylidene)-1-methyl-5-oxo-4,5-dihydroimidazole-2-carbaldehyde oxime ("MFHO"); 4-(3,5-difluoro-4-hydroxybenzylidene)-1-methyl-5-oxo-4,5-dihydro-1H-imidazole-2-carbaldehyde oxime; 4-(3,5-difluoro-4-hydroxybenzydene)-1-methyl-5-oxo-4,5-dihydro-1H-imidazole-2-carb oxylic acid; 4-(3-fluoro-4-hydroxy-5-methoxybenzydene)-1-methyl-5-oxo-4,5-dihydro imidazole-2-carboxylic acid; 4-(3,5-difluoro-4-hydroxybenzylidene)-1-methyl-5-oxo-4,5-dihydro-1H-imidazole-2-carboxamide; difluoro-4-hydroxybenzylidene)-N,1-dimethyl-5-oxo-4,5-dihydroimidazole-2-carboxamide; 4-(3-fluoro-4-hydr oxy-5-methoxybenzydene)-N,1-dimethyl-5-oxo-4,5-dihydro imidazole-2-carboxamide; methyl 3-((Z)-4-(3,5-difluoro-4-hydroxybenzylidene)-1-methyl-5-oxo-4,5-dihydro-1H-imidazol-2-yl)acrylate ("DFAME"); methyl 3-(4-(3-fluoro-4-hydroxy-5-methoxybenzylidene)-1-methyl-5-oxo-4,5-dihydro-1H-imidazol-2-yl)acrylate, 4-(3-fluoro-4-hydroxy-5-methoxybenzylidene)-1,2-dimethyl-1H-imidazol-5(4H)-one ("MFHBI"), and combinations thereof. In one specific example, the fluorophore is DFHBI.

The isolated nucleic acid sequence of the first aspect can be a ribonucleic acid (RNA) sequence, a deoxyribonucleic acid (DNA) sequence, a sequence comprising non-natural nucleic acids, or a sequence comprising nucleic acid analogues. In one specific example, the isolated nucleic acid sequence of the first aspect is an RNA sequence.

In some examples, the isolated nucleic acid sequence of the first aspect comprises the sequence as defined by SEQ ID NO: 2, or by a combination comprising SEQ ID NO: 1, followed by SEQ ID NO: 2658, followed by SEQ ID NO: 2659. In some examples, the sequence as defined by SEQ ID NO:2 represents the core template of the isolated nucleic acid sequence of the first aspect. In one example, the core template refers to the sequence of the nucleotides in region $R_3$, as illustrated in FIG. 12.

In some examples, the isolated nucleic acid sequence of the first aspect comprises any one of the sensor sequences as listed in Table 1, i.e. nucleic acid sequences of SEQ ID NOs: 2618 to 2632, 2634, 2636, 2638, 2640, 2641, 2643, 2645, 2647, 2649, 2651, 2652 and 2654.

TABLE 1

Examples of RNA sensors.

| SEQ ID NO. of sensor | Name of Sensor | Sequence of Sensor (5' to 3') | Name of Target RNA | Sequence of Target RNA (5' to 3') |
|---|---|---|---|---|
| 2618 | PNDN-bantam-3p | GGGACACCUGAGUGUCCCAAUCAGCUUUCUUGUUGAGUAGAGUGUGA GCUCCGUAACUAGUUACAUCACGGGAGAUGUAACUGAAUGAAAUGGU GAAGGACGGGUCCAAAUGAUCUCAUGCUUCGGCA | bantam-3p | UGAGAUCAUUUU GAAAGCUGAUU (SEQ ID NO.: 2617) |
| 2619 | PNDN-dme-miR-263a | GGGACACCUGAGUGUCCCCCGUGAAUUCUUCCUUGUUGAGUAGAGU GUGAGCUCCGUAACUAGUUACAUCACGGGAGAUGUAACUGAAUGAAA UGGUGAAGGACGGGUCCAUGCCAUUUGCUUCGGCA | mir-263a | AAUGGCACUGGA AGAAUUCACGGG (SEQ ID NO.: 2609) |
| 2620 | PNDN-dme-miR-263a_6nt (PNDN-dme-miR-263a with 6nt in SL3) | GGGACACCUGAGUGUCCCCCGUGAAUUCUUCCUUGUUGAGUAGAGU GUGAGCUCCGUAACUAGUUACAUCACGGGAGAUGUAACUGAAUGAAA UGGUGAAGGACGGGUCCAUGCCAUUGGCUGCUUCGGCAGCC | | |
| 2621 | PNDN 263a_9nt (PNDN 263a with 9nt in SL3) | GGGACACCUGAGUGUCCCCCGUGAAUUCUUCCUUGUUGAGUAGAGU GUGAGCUCCGUAACUAGUUACAUCACGGGAGAUGUAACUGAAUGAAA UGGUGAAGGACGGGUCCAUGCCAUUGUAGGCUGCUUCGGCAGCCUAC | | |

TABLE 1-continued

Examples of RNA sensors.

| SEQ ID NO. of sensor | Name of Sensor | Sequence of Sensor (5' to 3') | Name of Target RNA | Sequence of Target RNA (5' to 3') |
|---|---|---|---|---|
| 2622 | PNDN 263a_12nt (PNDN 263a with 12nt in SL3) | GGGACACCUGAGUGUCCCCCGUGAAUUCUUCCUUGUUGAGUAGAGU GUGAGCUCCGUAACUAGUUACAUCACGGGAGUAGUAACUGAAUGAAA UGGUGAAGGACGGGUCCAUGCCAUUGACGUAGGCUGCUUCGGCAGCC UACGUC | | |
| 2623 | PNDN-dme-bantam5p | GGGACACCUGAGUGUCCCAGUCAAACCAUUGUUGAGUAGAGUGUGAG CUCCGUAACUAGUUACAUCACGGGAGAUGUAACUGAAUGAAAUGGUG AAGGACGGGUCCAUCGAAAACCGGUGCUUCGGCA | bantam5p | CCGGUUUUCGAU UUGGUUUGACU (SEQ ID NO.: 2599) |
| 2624 | PNDN-bantam-5p_6nt (PNDN-bantam-5p with 6nt in SL3) | GGGACACCUGAGUGUCCCAGUCAAACCAUUGUUGAGUAGAGUGUGAG CUCCGUAACUAGUUACAUCACGGGAGAUGUAACUGAAUGAAAUGGUG AAGGACGGGUCCAUCGAAAACCGGGGCUGCUUCGGCAGCC | | |
| 2625 | PNDN bantam5p_9nt (PNDN bantam5p with 9nt in SL3) | GGGACACCUGAGUGUCCCAGUCAAACCAUUGUUGAGUAGAGUGUGAG CUCCGUAACUAGUUACAUCACGGGAGAUGUAACUGAAUGAAAUGGUG AAGGACGGGUCCAUCGAAAACCGGGUAGGCUGCUUCGGCAGCCUAC | | |
| 2626 | PNDN bantam5p_12nt (PNDN bantam5p with 12nt SL3) | GGGACACCUGAGUGUCCCAGUCAAACCAUUGUUGAGUAGAGUGUGAG CUCCGUAACUAGUUACAUCACGGGAGAUGUAACUGAAUGAAAUGGUG AAGGACGGGUCCAUCGAAAACCGGGACGUAGGCUGCUUCGGCAGCCU ACGUC | | |
| 2627 | PNDN bantam5p_10nt (PNDN bantam5p with 10nt in SL4) | GGGACACUUGCUGACAAGUGUCCCAGUCAAACCAUUGUUGAGUAGAG UGUGAGCUCCGUAACUAGUUACAUCACGGGAGAUGUAACUGAAUGAA AUGGUGAAGGACGGGUCCAUCGAAAACCGGGGCUGCUUCGGCAGCC | | |
| 2628 | PNDN bantam5p_13nt (PNDN bantam5p 13nt in SL4) | GGGACACUUGCAGCUGACUGCAAGUGUCCCAGUCAAACCAUUGUUGA GUAGAGUGUGAGCUCCGUAACUAGUUACAUCACGGGAGAUGUAACUG AAUGAAAUGGUGAAGGACGGGUCCAUCGAAAACCGGGGCUGCUUCGG CAGCC | | |
| 2629 | PNDN-dme-miR-1000 | GGGACACCUGAGUGUCCCACUGCUGUGUUGUUGAGUAGAGUGUGAGC UCCGUAACUAGUUACAUCACGGGAGAUGUAACUGAAUGAAAUGGUGA AGGACGGGUCCAAGGACAAUAUUGCUUCGGCA | mir-1000 | AUAUUGUCCUGU CACAGCAGU (SEQ ID NO.: 2611) |
| 2630 | PNDN-dme-miR-1000_6nt (PNDN-dme-miR-1000 with 6nt in SL3) | GGGACACCUGAGUGUCCCACUGCUGUGUUGUUGAGUAGAGUGUGAGC UCCGUAACUAGUUACAUCACGGGAGAUGUAACUGAAUGAAAUGGUGA AGGACGGGUCCAAGGACAAUAUGGCUGCUUCGGCAGCC | | |
| 2631 | PNDN 1000_9nt (PNDN 1000 with 9nt in SL3) | GGGACACCUGAGUGUCCCACUGCUGUGUUGUUGAGUAGAGUGUGAGC UCCGUAACUAGUUACAUCACGGGAGAUGUAACUGAAUGAAAUGGUGA AGGACGGGUCCAAGGACAAUAUGUAGGCUGCUUCGGCAGCCUAC | | |
| 2632 | PNDN 1000_12nt (PNDN 1000 with 12nt in SL3) | GGGACACCUGAGUGUCCCACUGCUGUGUUGUUGAGUAGAGUGUGAGC UCCGUAACUAGUUACAUCACGGGAGAUGUAACUGAAUGAAAUGGUGA AGGACGGGUCCAAGGACAAUAUGACGUAGGCUGCUUCGGCAGCCUAC GUC | | |
| 2634 | PNDN-hsa-miR21-5p | GGGACACCUGAGUGUCCCGUCAACAUCUUGUUGAGUAGAGUGUGAGC UCCGUAACUAGUUACAUCACGGGAGAUGUAACUGAAUGAAAUGGUGA AGGACGGGUCCAUCGAUAAGCUACUGCUUCGGCA | hsa_miR-21-5p | GUAGCUUAUCAG ACUGAUGUUGAC (SEQ ID NO.: 2633) |
| 2636 | PNDN-hsa_miR-375 | GGGACACCUGAGUGUCCCCACGCGAGCCGUUGUUGAGUAGAGUGUGA GCUCCGUAACUAGUUACAUCACGGGAGAUGUAACUGAAUGAAAUGGU GAAGGACGGGUCCACGAACAAAUGCUUCGGCA | hsa_miR-375 | UUUGUUCGUUCG GCUCGCGUG (SEQ ID NO.: 2635) |

TABLE 1-continued

Examples of RNA sensors.

| SEQ ID NO. of sensor | Name of Sensor | Sequence of Sensor (5' to 3') | Name of Target RNA | Sequence of Target RNA (5' to 3') |
|---|---|---|---|---|
| 2638 | PNDN-hsa-miR-223-3p | GGGACACCUGAGUGUCCCUUGGGGUAUUUGUUGUUGAGUAGAGUGUGAGCUCCGUAACUAGUUACAUCACGGGAGAUGUAACUGAAUGAAAUGGUGAAGGACGGGUCCAAAACUGACUGCUUCGGCA | has_miR-223-3p | GUCAGUUUGUCAAAUACCCCAA (SEQ ID NO.: 2637) |
| 2640 | PNDN-hsa_miR-223-5p | GGGACACCUGAGUGUCCCCAACUCAGCUUGUCUUGUUGAGUAGAGUGUGAGCUCCGUAACUAGUUACAUCACGGGAGAUGUAACUGAAUGAAAUGGUGAAGGACGGGUCCAAUACACGUGCUUCGGCA | hsa_miR-223-5p | CGUGUAUUUGACAAGCUGAGUUG (SEQ ID NO.: 2639) |
| 2641 | PNDN-hsa_miR-122 | GGGACACCUGAGUGUCCCCAAACACCUUGUUGAGUAGAGUGUGAGCUCCGUAACUAGUUACAUCACGGGAGAUGUAACUGAAUGAAAUGGUGAAGGACGGGUCCAUGUCACACUCCAUGCUUCGGCA | hsa_miR-122 | UGGAGUGUGACAAUGGUGUUUG (SEQ ID NO.: 74) |
| 2643 | PNDN-hsa_let7f | GGGACACCUGAGUGUCCCACAACUAUACAUUGUUGAGUAGAGUGUGAGCUCCGUAACUAGUUACAUCACGGGAGAUGUAACUGAAUGAAAUGGUGAAGGACGGUCCACUACUACCUCAUGCUUCGGCA | hsa_let7f | UGAGGUAGUAGAUUGUAUAGUUGU (SEQ ID NO.: 2642) |
| 2645 | PNDN-dme-miR-124 | GGGACACCUGAGUGUCCCUUGGCAUUCUUGUUGAGUAGAGUGUGAGCUCCGUAACUAGUUACAUCACGGGAGAUGUAACUGAAUGAAAUGGUGAAGGACGGGUCCACGCGUGCCUUAGGCUGCUUCGGCAGCCUAAGGCACGCGGUGAAUGCCAA | dme-miR-124 | UAAGGCACGCGGUGAAUGCCAA (SEQ ID NO.: 2644) |
| 2647 | PNDN-dme-miR-14 | GGGACACCUGAGUGUCCCAUAGGAGAGAGUUGUUGAGUAGAGUGUGAGCUCCGUAACUAGUUACAUCACGGGAGAUGUAACUGAAUGAAAUGGUGAAGGACGGGUCCAAAAGACUGAGGCUGCUUCGGCAGCCUCAGUCUUUUUCUCUCUCCUAU | dme-miR-14 | UCAGUCUUUUUCUCUCUCCUAU (SEQ ID NO.: 2646) |
| 2649 | PNDN-dme-miR-184 | GGGACACCUGAGUGUCCCGCCCUUAUCUUGUUGAGUAGAGUGUGAGCUCCGUAACUAGUUACAUCACGGGAGAUGUAACUGAAUGAAAUGGUGAAGGACGGGUCCAUUCUCCGUCCAGGCUGCUUCGGCAGCC | dme-miR-184 | UGGACGGAGAACUGAUAAGGGC (SEQ ID NO.: 2648) |
| 2651 | PNDN-dme-miR-252 | GGGACACCUGAGUGUCCCUCCUGCGGCUUGUUGAGUAGAGUGUGAGCUCCGUAACUAGUUACAUCACGGGAGAUGUAACUGAAUGAAAUGGUGAAGGACGGGUCCAUAGUACUUAGGGCUGCUUCGGCAGCC | dme-miR-252 | CUAAGUACUAGUGCCGCAGGAG (SEQ ID NO.: 2650) |
| 2652 | PNDN_snoR442_5' | GGGACACCUGAGUGUCCCGAAUCACACCCUUGUUGAGUAGAGUGUGAGCUCCGUAACUAGUUACAUCACGGGAGAUGUAACUGAAUGAAAUGGUGAAGGACGGGUCCACAGGCUUGCGUGCUUCGGCA | snoR442 5' region | CGCAAGCCUGUUGGGUGUGAUUC (SEQ ID NO.: 2615) |
| 2654 | PNDN_snoR442_3' | GGGACACCUGAGUGUCCCGAUCAGAGUAUUGUUGAGUAGAGUGUGAGCUCCGUAACUAGUUACAUCACGGGAGAUGUAACUGAAUGAAAUGGUGAAGGACGGGUCCAUAUGACAAGCAUGCUUCGGCA | snoR442 3' region | UGCUUGUCAUAGUUACUCUGAUC (SEQ ID NO.: 2653) |

The underline (_____) sequence represents the sequence complementary to 3' end of the target RNA, the wavy underline (∿∿∿∿∿) sequence represents the sequence complementary to 5' end of the target RNA.

The isolated nucleic acid sequence of the first aspect can be used for the detection of a target nucleic acid sequence in an animal. Thus, in a second aspect, the present invention provides a method of detecting a target nucleic acid sequence in an animal, wherein the method comprises using the isolated nucleic acid sequence of the first aspect. In one example, the method comprises the steps of (i) contacting the isolated nucleic acid sequence of the first aspect with a detection agent and a sample obtained from the animal; and (ii) measuring the signal level from the detection agent.

The animal can be a mammalian animal or a non-mammalian animal. Examples of such animals include but are not limited to *Drosophila*, human, mouse, and zebra fish.

The term "sample" as used herein refers to a sample suspected of containing the target nucleic acid sequence. It may comprise a bodily fluid. The term "sample" used herein refers to a biological sample, or a sample that comprises at least some biological materials such as nucleic acids. The biological samples of this disclosure may be any sample suspected to contain the target nucleic acid sequence, including liquid samples, such as whole blood, blood serum, blood plasma, cerebrospinal fluid, central spinal fluid, lymph fluid, cystic fluid, sputum, stool, pleural effusion, mucus, pleural fluid, ascitic fluid, amniotic fluid, peritoneal fluid, saliva, bronchial washes, urine and other bodily fluid, or extracts thereof. It may also comprise an extract from a cell, chromosome, or organelle; genomic DNA, RNA, or cDNA.

In one example, the detecting of the target nucleic acid is in real-time.

The term "real-time" as used herein refers to the detection of the target nucleic acid sequence as the sequence is being produced, or the detection of the quantity of the target nucleic acid sequence as the quantity is changing with time. In some examples, the quantity of the target nucleic acid is increasing as it is being monitored, while in some other examples, the quantity of the target nucleic acid is decreasing as it is being monitored.

The target nucleic acid sequence to be detected can be a disease-specific nucleic acid sequence.

A large number of different target nucleic acid sequences can be detected using the isolated nucleic acid sequence of the first aspect, as the specific sequence of domains $C_1$ and $C_2$ can be designed based on the sequence of the target nucleic acid. Examples of the target nucleic acid sequences that can be detected include but not limited to the sequences of SEQ ID NO: 10 to 2597.

miRNAs are an emerging class of biomarkers, which are misregulated in a number of diseases. miRNA expression signatures (for example, up-regulations and down-regulations as compared to normal subject) have shown promise for use in diagnosis, staging of diseases, prognosis and as predictors of clinical response. For example, miRNA signatures correlate with neoplastic events, allowing early detection of cancer; circulating miRNAs have been detected patients with diffuse large B cell lymphoma. Therefore, method and systems for the detection and quantification of miRNAs have broad applicability.

Thus, in a third aspect, the present invention provides a method of determining if a subject has a disease or is at increased risk of developing a disease, wherein said method comprises providing a sample comprising nucleic acids from a subject and detecting one or more target nucleic acid sequences that bind to the isolated nucleic acid of the first aspect. In one example, the method comprises the steps of (i) contacting the isolated nucleic acid sequence of the first aspect with a detection agent and the sample from the subject; and (ii) measuring the signal level from the detection agent.

In a fourth aspect, the present invention provides a method of treating a patient which has a disease or is at increased risk of developing a disease, wherein said method comprises (i) providing a sample comprising nucleic acids from a patient and detecting one or more target nucleic acid sequences that bind to the isolated nucleic acid sequence of the first aspect, and (ii) administering to the patient one or more therapeutic agents for the treatment of the disease associated with the one or more target nucleic acid sequences detected in (i). In one example, steps (i) comprises (a) contacting the isolated nucleic acid sequence of the first aspect with a detection agent and the sample from the patient; and (ii) measuring the signal level from the detection agent.

Examples of such diseases include but are not limited to cardiac ischemia, diabetes, sepsis, rheumatoid arthritis, hepatic ischemia, hepatitis C, cardiac disease, Alzheimer's disease, Parkinson's disease, spinal motor neuron disease and cancer. Examples of cancer includes but are not limited to colorectal cancer, glioblastomas, neuroblastomas, acute myelogenous leukaemia, chronic lymphocytic leukaemia, lung cancer, non-small cell lung cancer, small cell lung cancer, B-cell lymphoma, T-cell lymphoma, multiple lymphoma, ovarian cancer, breast cancer, hepatocellular cancer, pancreatic cancer, prostate cancer and squamous cell carcinomas.

Currently available methods for determining if a patient has a disease or is at increased risk of developing a disease generally require complex biochemical processing and analysis of the sample. Such methods are thus time consuming, expensive, and require specialized skill set for analysis. In contrast, the methods of the third aspect could provide a fast and simple assay system suitable for use in the clinical laboratory without the need for advanced skills of the lab technicians.

In the fifth aspect, the present invention provides a kit comprising the isolated nucleic acid of the first aspect and a detection agent described herein.

The invention illustratively described herein may suitably be practiced in the absence of any element or elements, limitation or limitations, not specifically disclosed herein. Thus, for example, the terms "comprising", "including", "containing", etc. shall be read expansively and without limitation. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments and optional features, modification and variation of the inventions embodied therein herein disclosed may be resorted to by those skilled in the art, and that such modifications and variations are considered to be within the scope of this invention.

The invention has been described broadly and generically herein. Each of the narrower species and subgeneric groupings falling within the generic disclosure also form part of the invention. This includes the generic description of the invention with a proviso or negative limitation removing any subject matter from the genus, regardless of whether or not the excised material is specifically recited herein.

Other embodiments are within the following claims and non-limiting examples. In addition, where features or aspects of the invention are described in terms of Markush groups, those skilled in the art will recognize that the invention is also thereby described in terms of any individual member or subgroup of members of the Markush group.

EXPERIMENTAL SECTION

Example 1—Design and Preparation of Sensors

A fluorescent RNA-fluorophore complex, Spinach, has previously been used as a tag for mRNAs, and has also been adapted for use as sensors for small molecule metabolites screenings. The RNA scaffold of Spinach forms a binding site for a fluorophore, 3,5-difluoro-4-hydroxybenzylidene imidazolinone (DFHBI), which becomes fluorescent upon binding to the RNA scaffold.

Spinach2 is an aptamer that differs from Spinach by a few nucleotides, but is of a similar structure as the Spinach aptamer. Spinach2 is a single linear RNA molecule that was computationally predicted (mFold) to fold into a structure comprising four stem-loop regions (FIG. 6A). Spinach2 is brighter with better fluorescence properties as compared to Spinach. The crystal structure of Spinach2 when bound to the fluorophore DFHBI was then solved and shown to instead consist of a three-tetrad quadruplex flanked by two helices. The solved structure is diagrammed in simplified 2D form in FIG. 6B, and in detailed form in FIG. 6C. Although the strategy and experiments for the sensor design began with the mFold structure, prior to the publications of the crystal structure, for simplicity the experiments are illustrated in terms of the solved structure.

The inventors reasoned that a sensor with fluorescence properties similar to Spinach2 could be assembled from two different RNA molecules if the structural elements required for stable complex formation with DHFBI could be reconstituted by base pairing between these two RNA molecules. To make a bimolecular microRNA sensor, part of the structure of Spinach2 would have to be removed and replaced by sequences complementary to the miRNA, so that binding of the miRNA is required for stable complex formation. Sequences complementary to the miRNA in this duplex region could form the basis of a sensor. This would require two modifications: (i) to circularly permutate Spinach, changing the positions of the 5' and 3' ends of the RNA aptamer to reside within Stem-loop P3 (SL P3); and (ii) to introduce a second sequence-variable stem loop adjacent to SL P3. As the predicted mFold structure contained two stem loops adjacent to SL P3, a possible strategy was to alter one of them. Another strategy was to introduce a new stem-loop. The inventors systematically tested the modifications required for this approach to be feasible.

To produce a circularly permuted (CP) version of Spinach RNA, with the 5' end in SL P3, part of the T7 transcriptional start site needs to be incorporated into SL P3 without compromising fluorescence. Extending SL P3 by adding the partial T7 transcriptional start sequence GGGA did not reduce fluorescence (FIG. 7A, SL P3 T7). Using the T7 transcription start site in SL P3, the inventors synthesized a version of Spinach RNA in which the original 3' and 5' ends in stem P1 were connected with a short additional loop to produce a CP Spinach molecule. CP Spinach2 retained about 50% of the fluorescence of Spinach2 (FIG. 7A, CP Spinach2). An RNA in which the sequence of Spinach was randomly rearranged did not fluoresce (FIG. 7A, Scrambled Spinach2).

The CP Spinach design allowed for the possibility of a bimolecular sensor. To function, the sensor would require a second, adjacent stem loop whose sequence could also be varied. The inventors tested whether insertion of a new stem loop adjacent to Stem-loop P3 (SL P3) would be compatible with fluorescence. A second copy of the SL P3 sequence was inserted on the 5' side of the original SL P3 (FIG. 6A-C, grey arrow heads) or on the 3' side of the original SL P3 (FIG. 6A-C, black arrow heads). In both positions, this modification resulted in a functional fluorescent molecule (Dup SL P3, FIG. 7B). Next, the inventors tested adding a stem loop with a different sequence. This was well tolerated when inserted 3' to SL P3, but not when inserted at 5' to SL P3 (new SL P3 5', FIG. 7B). The inventors named the predicted three-stem loop fluorescent RNA-complex, Pandan (FIG. 8).

In short, the present inventors have redesigned Spinach so that folding to create a DFHBI-binding scaffold depends on interaction between a miRNA and a sequence complementary RNA backbone. This sensor family was named by the inventors as Pandan, after a plant used to provide an aromatic green coloring in Southeast Asian cooking. Binding of the target miRNA to the Pandan sensor reconstitutes an RNA structure capable of binding the DFHBI fluorophore in a manner similar to the Spinach2 aptamer. This novel aptamer serves as an RNA sensor that directly detects microRNAs by fluorophore binding.

Pandan sensors can be adapted for the detection of any miRNA. The sensors were designed by encoding complementary sequence for the 5' region of the target miRNA within Stem-loop P3 (SL P3), and the 3' region of the target miRNA within Stem-loop P4 (SL P4) of Pandan, with two unpaired nucleotides in the microRNA between the two portions. In some examples, the sensors were designed so that miRNA binding would result in a Uracil (U) in the second unpaired base downstream of SL P3. The online mFold server was then used to determine whether the sensor and miRNA pair were predicted to properly fold into the Pandan structure using a sequence where the sensor and miRNA were encoded as a single molecule.

The Pandan aptamer contains two adjacent stem loops (P3 and P4) that are essential for complex stability, but whose sequence can be varied. This structure allows the RNA portion of the RNA-fluorophore complex to be reconstituted by the binding of two separate RNA molecules, one of which can be any short RNA sequence.

Single stranded DNA templates for designed sensors (synthesized by Sigma Aldrich or IDT) were amplified using PCR to create double stranded DNA templates using primers that included a 5' T7 promoter sequence (5'-GTATAATACGACTCACTATAGGGA-3', SEQ ID NO: 9). PCR products were purified using PCR purification columns (Qiagen) and used as templates for in vitro T7 transcription (Epicentre) following the manufacturers' protocols. RNA sensors were extracted with ammonium acetate (5M) and phenolchloroform, and precipitated with isopropanol using standard procedures. RNA pellets were then suspended in nuclease-free water, their concentration measured on a Nanodrop instrument. Samples were stored at 80° C.

A specific RNA sensor is designed for each miRNA (or small RNA) by incorporating complementary sequence for the miRNA into the sensor backbone (FIG. 9B).

The sequence of the sensor backbone comprises: 5'-GGGACACCUGAGUGUCCCn-3' (SEQ ID NO: 1), wherein n of SEQ ID NO: 1 represents a sequence complementary to the target RNA and n of SEQ ID NO: 1 is attached to 5'-UUGUUGAGUAGAGUGUGAG-CUCCGUAACUAG UUACAUCACGGGAGAU-GUAACUGAAUGAAAUGGUGAAGGACGGGUCCn-3' (SEQ ID NO: 2658), wherein n of SEQ ID NO: 2658 represents a sequence complimentary to the target RNA and n of SEQ ID NO: 2658 is attached to 5'-GGCUGC-UUCGGCAGCC-3' (SEQ ID NO: 2659).

An example is given here for *Drosophila* miR-1 (In bold is the unpaired portion of the microRNA with the second unpaired base being a U):

```
Sequence of dme-miR-1
                                    (SEQ ID NO.: 4)
5'-UGGAAUGUAAAGAAGUAUGGAG-3'

Reverse complement of 3' paired seq
                                    (SEQ ID NO.: 5)
CUCCAUACUUCUUU Reverse complement of 5' paired seq
                                    (SEQ ID NO.: 6)
AUUCCA Foward primer:
                                    (SEQ ID NO.: 7)
GTATAATACGACTCACTATAGGGACACCTGAGTGTCC
CCTCCATACTTCTTTTTGTTGAGTAGAGTGTGAGCTC
Reverse primer:
                                    (SEQ ID NO.: 8)
GGCTGCCGAAGCAGCCTGGAATTGGACCCGTCCT
TCACCATTTCATTCAGT
```

Core template (can be used for all sensors):

(SEQ ID NO.: 2)
UUGUUGAGUAGAGUGUGAGCUCCGUAACUAGUUACAUCACGGGAGAUG
UAACUGAAUGAAAUGGUGAAGGACGGGUCCA.

Resulting sequence-specific sensor (sensor PNDN-dme-miR-1):

(SEQ ID NO.: 3)
GGGACACCUGAGUGUCCCCUCCAUACUUCUUUUUGUUGAGUAGAGUGU
GAGCUCCGUAACUAGUUACAUCACGGGAGAUGUAACUGAAUGAAAUGG
UGAAGGACGGGUCCAAUUCCAGGCUGCUUCGGCAGCC.

The predicted secondary structure of the designed RNA sensor is then checked using Mfold to ensure correct folding.

In vitro transcription of sensor from DNA template is carried out using Ampliscribe T7-Flash Transcription Kit (Epicenter) according to the manufacturer's instructions. The RNA is then purified by phenol/chloroform extraction and isopropanol precipitation.

Example 2—miRNA Detection by Sensor Fluorescence

The RNA sensor (1 µM), target miRNA (IDTDNA; variable concentrations) and DFHBI (10 µM; Lucerna Technologies) is incubated in solution with continuous shaking at 37° C. in buffer (40 mM HEPES pH 7.4, 125 mM KCl and 1 mM MgCl2) according to Paige et. al 2011 (Science 2011, (333) 642). Fluorescence is measured using a microplate reader (excitation wavelength 460 nm; emission wavelength 500 nm; slit widths 10 nm). Fluorescence measurement is then normalized to the maximum intensity of the fluorophore DFHBI alone.

Example 3—Pandan Sensors are Sensitive and Specific in Re Porting their MicroRNA of Interest Here, we show an example with Pandan-bantam-5p.
FIG. 2—Fluorescence fold change of Pandan-bantam-5p and DFHBI upon addition of 1 uM, 0.1 uM and 0.01 uM of bantam-5p microRNA, compared to DFHBI-only control.
FIG. 10B—The response of Pandan-bantam-5p to bantam-5p microRNA is linear.
FIG. 11A—Pandan-bantam-5p is specific for bantam-5p microRNA compared to miR-263a.

Example 4—Pandan Sensors Recognize MicroRNAs In Vitro

The sequences of both stem-loops P3 and the new additional stem-loop P4 can be varied. This allows the inventors to encode sequences complementary to target miRNAs into the Pandan sensor backbone (illustrated in FIG. 9B). Pandan sensors specific to *Drosophila* miRNAs dme-bantam-3p, dme-miR-263a and dme-miR-1000, as well as for several human miRNAs were designed.

RNA was extracted from 15-30 Canton S white (CS10) male flies using TRIzol reagent (Invitrogen) following the manufacturer's protocol. To detect target miRNA in this complex mixture of extracted RNA, synthetic target miRNA (1, 0.1 or 0.01 µM) (IDT), Pandan sensor (1 µM) and DFHBI or DFHBI-1T (10 µM) were added either to a solution of extracted RNA in a buffer containing 40 mM HEPES pH 7.4, 12 5 mM KCl and 1 mM MgCl2 or buffer control only without extracted RNA. Reactions were incubated at 37° C. for 1 h and fluorescence was recorded using a Tecan Safire2 fluorescence microplate reader with the following measurement parameters: excitation wavelength=460 nm; emission wavelength=501 nm; slit widths=10 nm. Experiments were carried out in triplicate for each data point.

In most cases, the sensor showed little or no fluorescence in the absence of the target miRNA. The fluorescence intensity of bound DFHBI increased between about 4- to 100-fold upon addition of target miRNA at 1 µM, compared to sensor or DFHBI alone (FIG. 11A). Fluorescence intensity increased with miRNA concentration (FIG. 11B), and the relationship was linear for the sensors that exhibited the brightest fluorescence: PNDN-bantam, PNDN-hsa-miR-21-5p, PNDN-hsa-let7f and PNDN-hsamiR-375 (FIG. 11B). The Pandan sensor PNDN-bantam-5p showed about 75% of the fluorescence intensity of Spinach2, on an equimolar basis, in the presence of its target miRNA (FIG. 11C).

Figure 3:
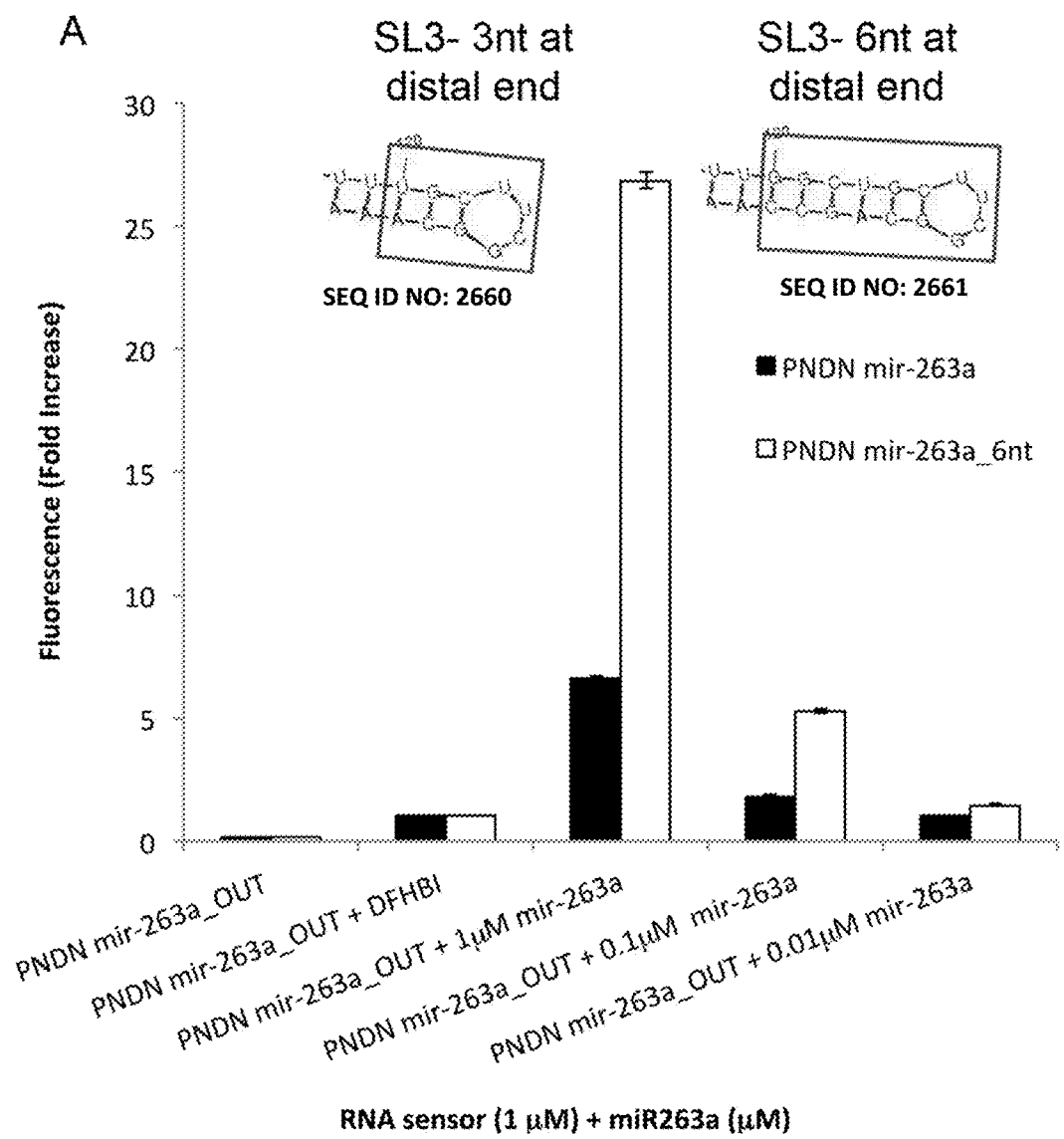
Figure 3:
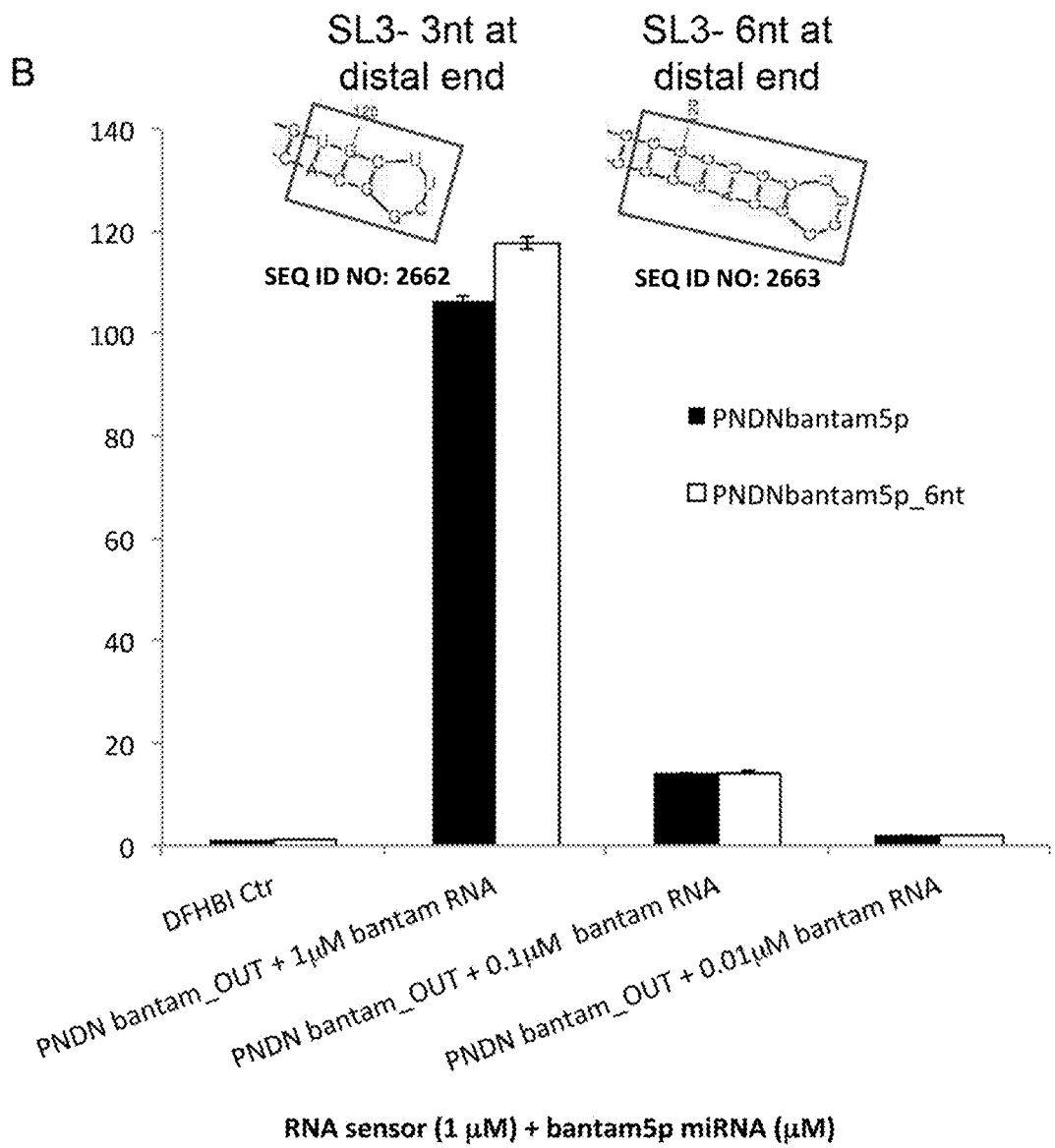
Figure 3:
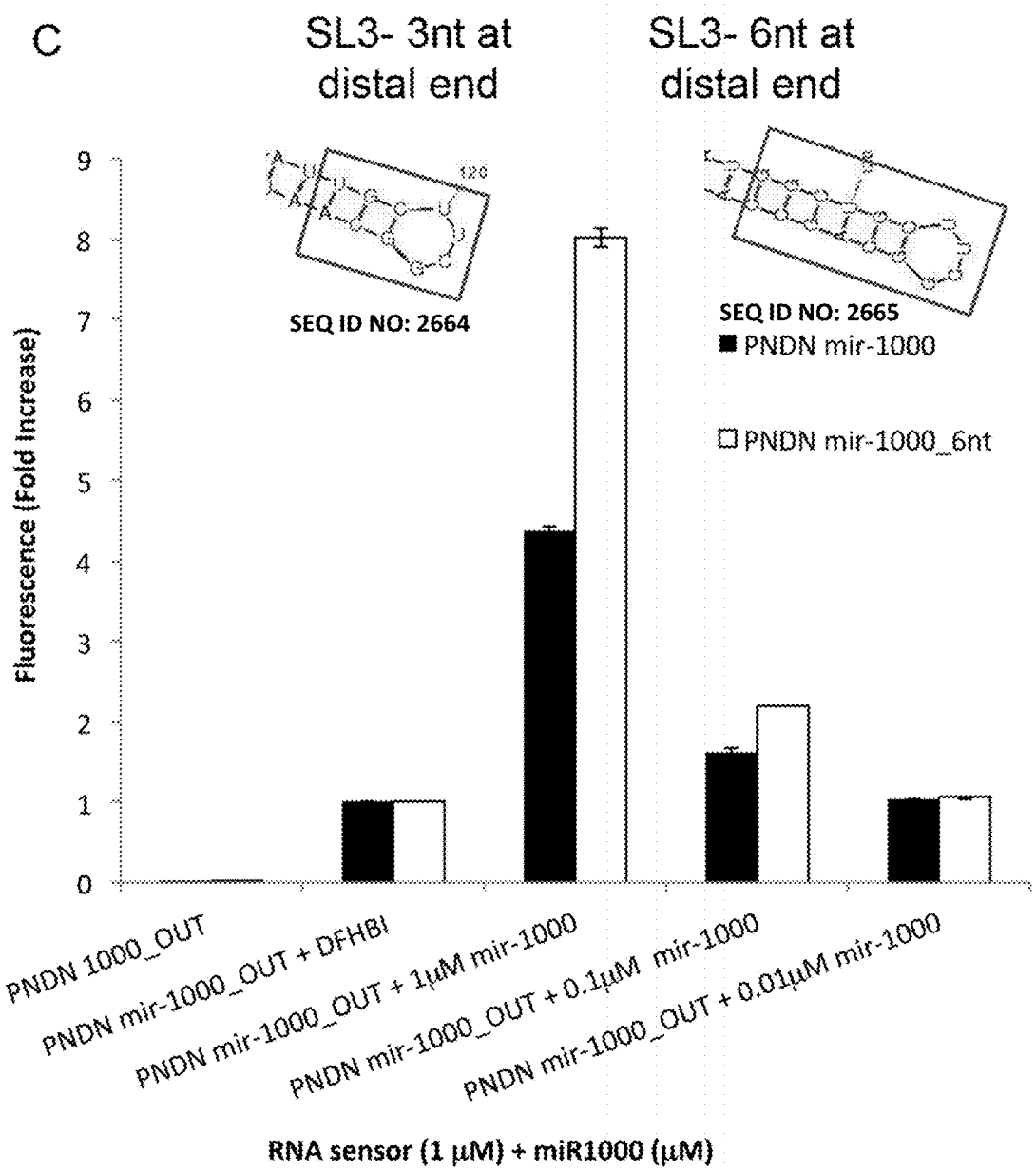
Figure 3:
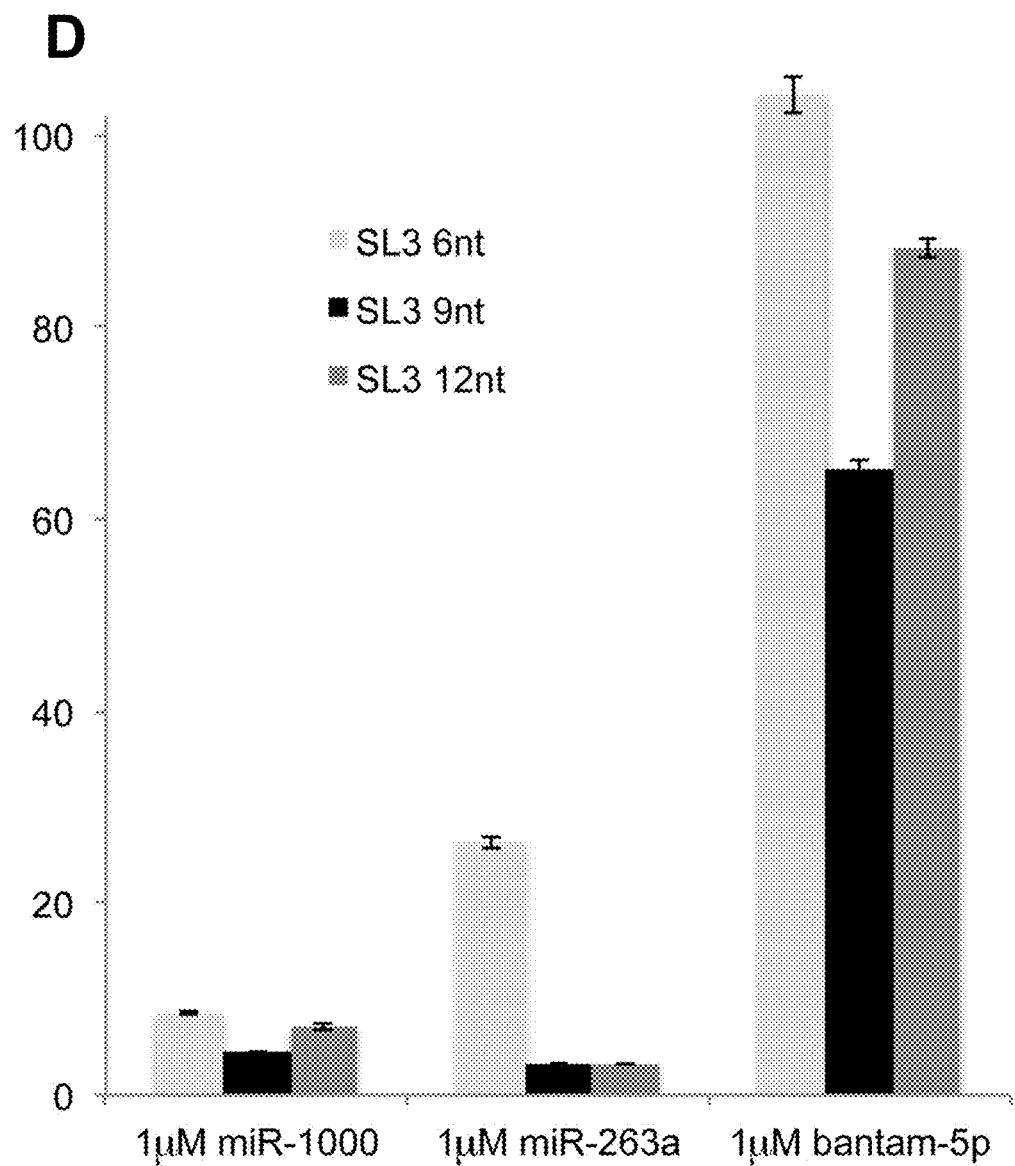
Figure 3:
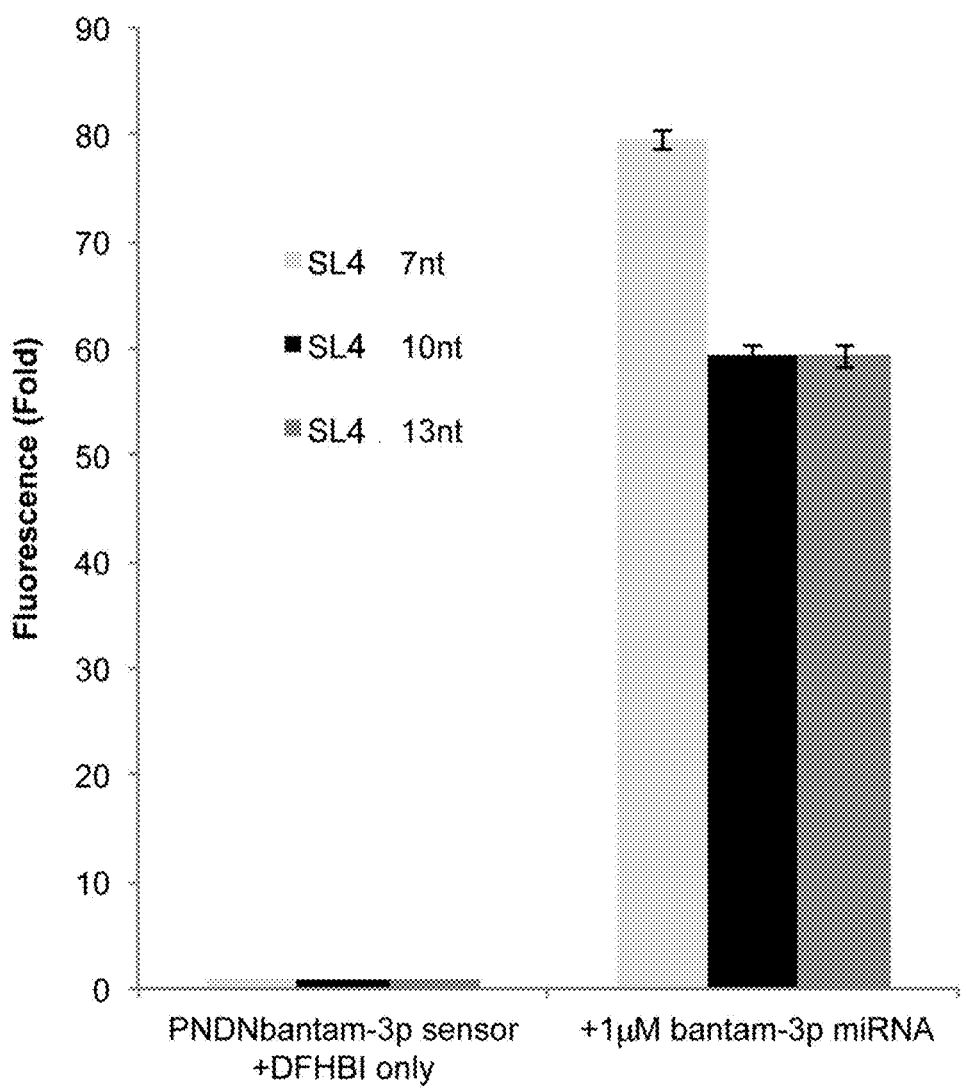
Figure 3:
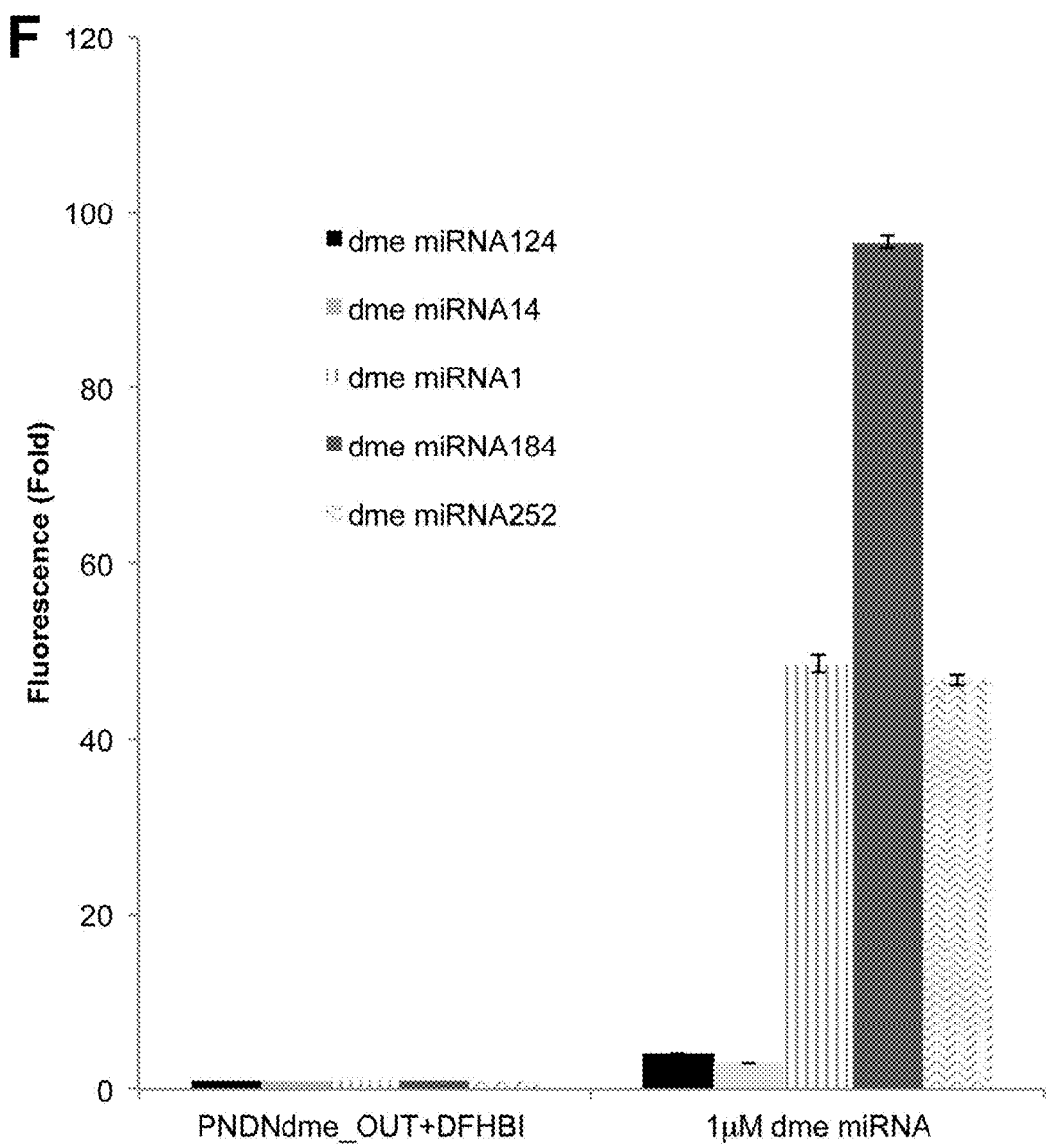

FIG. 3 presents tests of additional modifications to the basic sensor design. Extension of the self-pairing region of SL P3 from three to six residues improved low-sensitivity sensors: PNDN-miR-263a increased from about 7- to 27-fold and PNDN-miR-1000 from about 4- to about 8-fold, while having less impact on those that were already sensitive (FIG. 3A to C). Further extension of SL P3 did not further improve sensor signal (FIG. 3D). Extension of stem loop P4 did not improve sensor signal (FIG. 3E). Five additional *Drosophila* miRNA sensors with the extended P3 design showed fluorescence increases from about 3- to about 96-fold upon miRNA addition (FIG. 3F). The median increase in fluorescence was 49-fold for the 14 Pandan miRNA sensors tested (Table 2).

In some examples, the sensors were designed so that miRNA binding would result in a uracil (U) in the second nucleotide downstream of SL P3 (FIGS. 8 and 9B). The sensors tested function well when complementary sequences for at least 6 nucleotides on both ends of the miRNA are encoded in the sensor (e.g. dme-miR-1, Table 2). About 89% of all human miRNAs have a Uracil located at the 3' unpaired base, such that this Uracil residue is flanked by at least 6 nucleotides on both sides.

Example 5—Sequence Specificity

The inventors next investigated the sequence specificity of Pandan sensors. Addition of miR-263a to the bantam-5p-Pandan sensor in the presence of DFHBI did not increase its fluorescence (FIG. 11A). Nor did miR-263a reduce the sensitivity of this sensor to bantam-5p miRNA when the two miRNAs were added in equal concentrations. Similar results were obtained when probing the miR-1000 Pandan sensor with bantam-5p miRNA (FIG. 11A). Thus, Pandan sensors distinguish between miRNAs with dissimilar sequences.

Next, sequence changes were introduced into the test miRNAs to assess the ability of the sensors to differentiate between more closely related sequences. Changing three residues in the 5' arm of the miRNA strongly reduced sensor fluorescence for the three examples tested (FIG. 11B). Single nucleotide mismatches in the miRNA seed reduced bantam-5p sensor activity by about 20-50%, with the magnitude of the difference being somewhat dependent on the location of the mismatch (FIG. 11C).

For Pandan sensors to be useful for detecting miRNAs in biological samples, the sensor must be able to identify its target RNA in a complex mixture. To test this, total RNA from adult *Drosophila* were prepared and assayed the ability of the bantam-3p Pandan sensor to detect bantam-3p miRNA spiked into the RNA mixture at a range of concentrations. The presence of up to 1000-fold excess of competing RNA did not decrease the ability of bantam-3p sensor to detect bantam-3p (P>0.05; FIG. 11D).

TABLE 2

Raw fluorescence readings in arbitrary units (a.u.) for each of the tested sensors in the absence and presence of 1 μM target miRNA

| microRNA | # self-paired bases at 3' end of SL P3 | Sensor + DFHBI alone | Sensor + DFHBI + miRNA | Fold change |
|---|---|---|---|---|
| dme-bantam-5p | 6 | 395 | 46 464 | 118 |
| dme-bantam-5p | 3 | 434 | 46 278 | 107 |
| dme-miR-184 | 6 | 398 | 38 426 | 97 |
| dme-bantam-3p | 3 | 457 | 43 279 | 95 |
| hsa-miR21-5p | 3 | 425 | 29 018 | 68 |
| hsa-let7f | 3 | 553 | 36 679 | 66 |
| hsa-miR223-5p | 3 | 416 | 24 869 | 60 |
| hsa-miR375 | 3 | 443 | 25 957 | 59 |
| hsa-miR122 | 3 | 424 | 20 706 | 49 |
| dme-miR-1 | 6 | 406 | 19 720 | 49 |
| dme-miR-252 | 6 | 991 | 46 368 | 47 |
| dme-miR-263a | 6 | 416 | 11 172 | 27 |
| hsa-miR223-3p | 3 | 1518 | 20 756 | 14 |
| dme-miR-1000 | 6 | 3343 | 26 788 | 8 |

TABLE 2-continued

Raw fluorescence readings in arbitrary units (a.u.) for each of the tested sensors in the absence and presence of 1 μM target miRNA

| microRNA | # self-paired bases at 3' end of SL P3 | Sensor + DFHBI alone | Sensor + DFHBI + miRNA | Fold change |
|---|---|---|---|---|
| dme-miR-263a | 3 | 437 | 2903 | 7 |
| dme-miR-1000 | 3 | 5708 | 24 981 | 4 |
| dme-miR-124 | 6 | 10 522 | 41 931 | 4 |
| dme-miR-14 | 6 | 4708 | 14 175 | 3 |

Example 6—Pandan Sensors Detect Longer RNAs

Figure 5:
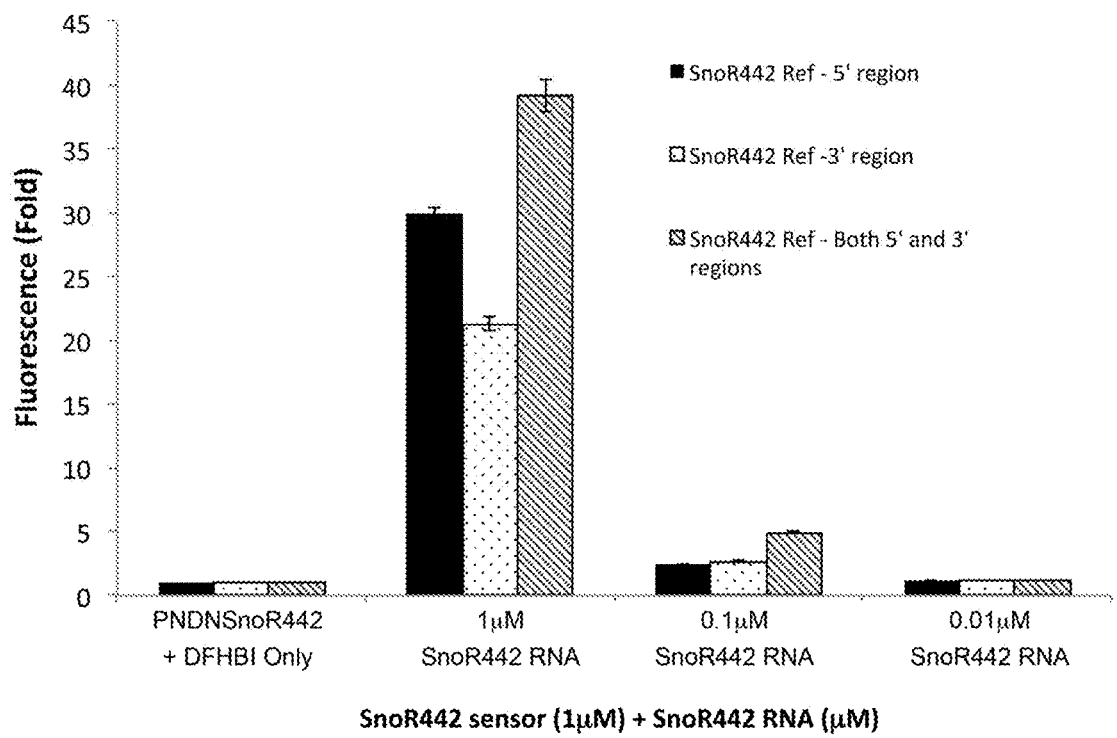

The Pandan sensors described above were designed to allow pairing to the entire 19-23 nucleotides of their respective target miRNAs. To explore whether sensors of this design could be used to detect longer RNA molecules, sensors were prepared for the 46-nt SnoR442 RNA. Pandan sensors complementary to the 5' or 3' 23-nt halves of SnoR442 were designed (FIG. 5). Both sensors were able to detect SnoR422. The extended unpaired sequence of the target does not appear to compromise sensor binding at either the 5' or 3' end. Combining the two sensors had an additive effect on raw fluorescence values, and increased fold fluorescence to a moderate degree (FIG. 5).

SEQUENCE LISTING (2672 sequences)

SEQ ID NO: 1 - RNA, 19 nt, Artificial Sequence
  Synthetic Sequence
  misc_feature (19)..(19): (n) is any naturally occurring nucleotide, wherein (n) is the sequence complementary to the target RNA; wherein this (n) is attached to SEQ ID NO 2658
gggacaccugagugucccn

SEQ ID NO: 2 - RNA, 79 nt, Artificial sequence
  Synthetic sequence
uuguugaguagagugugagcuccguaacuaguuacaucacgggagauguaacugaaugaaauggugaaggacgggucca

SEQ ID NO: 3 - RNA, 133 nt, Artificial sequence
  PNDN-dme-miR-1
gggacaccugaguguccccuccauacuucuuuuuguugaguagagugugagcuccguaacuaguuacaucacgggagauguaacugaaugaaauggugaaggacggguccaauuccaggcugcuucggcagcc

SEQ ID NO: 4 - RNA, 22 nt, Artificial sequence
  Drosophila melanogaster dme-miR-1
uggaauguaaagaaguauggag

SEQ ID NO: 5 - RNA, 14 nt, Artificial sequence
  Synthetic sequence
cuccauacuucuuu

SEQ ID NO: 6 - RNA, 6 nt, Artificial sequence
  Synthetic sequence
auucca

SEQ ID NO: 7 - DNA, 74 bp, Artificial sequence
  Synthetic sequence
gtataatacgactcactatagggacacctgagtgtcccctccatacttctttttgttgagtagagtgtgagctc

SEQ ID NO: 8 - DNA, 51 bp, Artificial sequence
  Synthetic sequence
ggctgccgaagcagcctggaattggacccgtccttcaccatttcattcagt

SEQ ID NO: 9 - DNA, 24 bp, Artificial sequence
  Synthetic sequence
gtataatacgactcactataggga

SEQ ID NO: 10 - RNA, 22 nt, Artificial sequence
  >hsa-let-7a-5p MIMAT0000062 Homo sapiens let-7a-5p
ugagguaguagguuguauaguu

SEQ ID NO: 11 - RNA, 22 nt, Artificial sequence
  >hsa-let-7a-2-3p MIMAT0010195 Homo sapiens let-7a-2-3p
cuguacagccuccuagcuuucc

SEQ ID NO: 12 - RNA, 21 nt, Artificial sequence
  >hsa-let-7a-3p MIMAT0004481 Homo sapiens let-7a-3p
cuauacaaucuacugucuuuc

SEQ ID NO: 13 - RNA, 22 nt, Artificial sequence
  >hsa-let-7b-3p MIMAT0004482 Homo sapiens let-7b-3p
cuauacaaccuacugccuuccc

SEQ ID NO: 14 - RNA, 22 nt, Artificial sequence
  >hsa-let-7b-5p MIMAT0000063 Homo sapiens let-7b-5p
ugagguaguagguugugugguu

SEQ ID NO: 15 - RNA, 22 nt, Artificial sequence
  >hsa-let-7c-3p MIMAT0026472 Homo sapiens let-7c-3p
cuguacaaccuucuagcuuucc

SEQ ID NO: 16 - RNA, 22 nt, Artificial sequence
  >hsa-let-7c-5p MIMAT0000064 Homo sapiens let-7c-5p
ugagguaguagguuguaugguu

SEQ ID NO: 17 - RNA, 22 nt, Artificial sequence
  >hsa-let-7d-3p MIMAT0004484 Homo sapiens let-7d-3p
cuauacgaccugcugccuuucu

SEQ ID NO: 18 - RNA, 22 nt, Artificial sequence
  >hsa-let-7d-5p MIMAT0000065 Homo sapiens let-7d-5p
agagguaguagguugcauaguu

SEQ ID NO: 19 - RNA, 22 nt, Artificial sequence
  >hsa-let-7e-3p MIMAT0004485 Homo sapiens let-7e-3p
cuauacggccuccuagcuuucc

SEQ ID NO: 20 - RNA, 22 nt, Artificial sequence
  >hsa-let-7e-5p MIMAT0000066 Homo sapiens let-7e-5p
ugagguaggagguuguauaguu

SEQ ID NO: 21 - RNA, 22 nt, Artificial sequence
  >hsa-let-7f-1-3p MIMAT0004486 Homo sapiens let-7f-1-3p
cuauacaaucuauugccuuccc

SEQ ID NO: 22 - RNA, 22 nt, Artificial sequence
  >hsa-let-7f-2-3p MIMAT0004487 Homo sapiens let-7f-2-3p
cuauacagucuacugucuuucc

SEQ ID NO: 23 - RNA, 22 nt, Artificial sequence
  >hsa-let-7f-5p MIMAT0000067 Homo sapiens let-7f-5p
ugagguaguagauuguauaguu

SEQ ID NO: 24 - RNA, 21 nt, Artificial sequence
  >hsa-let-7g-3p MIMAT0004584 Homo sapiens let-7g-3p
cuguacaggccacugccuugc

SEQ ID NO: 25 - RNA, 22 nt, Artificial sequence
  >hsa-let-7g-5p MIMAT0000414 Homo sapiens let-7g-5p
ugagguaguaguuuguacaguu

SEQ ID NO: 26 - RNA, 22 nt, Artificial sequence
  >hsa-let-7i-3p MIMAT0004585 Homo sapiens let-7i-3p
cugcgcaagcuacugccuugcu

SEQ ID NO: 27 - RNA, 22 nt, Artificial sequence
  >hsa-let-7i-5p MIMAT0000415 Homo sapiens let-7i-5p
ugagguaguaguuugugcuguu

SEQ ID NO: 28 - RNA, 22 nt, Artificial sequence
  >hsa-miR-1-3p MIMAT0000416 Homo sapiens miR-1-3p
uggaauguaaagaaguauguau

SEQ ID NO: 29 - RNA, 22 nt, Artificial sequence
  >hsa-miR-1-5p MIMAT0031892 Homo sapiens miR-1-5p
acauacuucuuuauaugcccau

SEQ ID NO: 30 - RNA, 22 nt, Artificial sequence
  >hsa-miR-100-3p MIMAT0004512 Homo sapiens miR-100-3p
caagcuuguaucuauagguaug

SEQ ID NO: 31 - RNA, 22 nt, Artificial sequence
  >hsa-miR-100-5p MIMAT0000098 Homo sapiens miR-100-5p
aacccguagauccgaacuugug

SEQ ID NO: 32 - RNA, 21 nt, Artificial sequence
  >hsa-miR-101-3p MIMAT0000099 Homo sapiens miR-101-3p
uacaguacugugauaacugaa

SEQ ID NO: 33 - RNA, 22 nt, Artificial sequence
  >hsa-miR-101-5p MIMAT0004513 Homo sapiens miR-101-5p
caguuaucacagugcugaugcu

SEQ ID NO: 34 - RNA, 23 nt, Artificial sequence
  >hsa-miR-103a-2-5p MIMAT0009196 Homo sapiens miR-103a-2-5p
agcuucuuuacagugcugccuug

SEQ ID NO: 35 - RNA, 23 nt, Artificial sequence
  >hsa-miR-103a-3p MIMAT0000101 Homo sapiens miR-103a-3p
agcagcauuguacagggcuauga

SEQ ID NO: 36 - RNA, 23 nt, Artificial sequence
  >hsa-miR-103b MIMAT0007402 Homo sapiens miR-103b
ucauagcccuguacaaugcugcu

SEQ ID NO: 37 - RNA, 22 nt, Artificial sequence
  >hsa-miR-105-3p MIMAT0004516 Homo sapiens miR-105-3p
acggauguuugagcaugugcua

SEQ ID NO: 38 - RNA, 23 nt, Artificial sequence
  >hsa-miR-105-5p MIMAT0000102 Homo sapiens miR-105-5p
ucaaaugcucagacuccuguggu

SEQ ID NO: 39 - RNA, 22 nt, Artificial sequence
  >hsa-miR-106a-3p MIMAT0004517 Homo sapiens miR-106a-3p
cugcaauguaagcacuucuuac

SEQ ID NO: 40 - RNA, 23 nt, Artificial sequence
  >hsa-miR-106a-5p MIMAT0000103 Homo sapiens miR-106a-5p
aaaagugcuuacagugcagguag

SEQ ID NO: 41 - RNA, 22 nt, Artificial sequence
  >hsa-miR-106b-3p MIMAT0004672 Homo sapiens miR-106b-3p
ccgcacuguggguacuugcugc

SEQ ID NO: 42 - RNA, 21 nt, Artificial sequence
  >hsa-miR-106b-5p MIMAT0000680 Homo sapiens miR-106b-5p
uaaagugcugacagugcagau

SEQ ID NO: 43 - RNA, 23 nt, Artificial sequence
  >hsa-miR-107 MIMAT0000104 Homo sapiens miR-107
agcagcauuguacagggcuauca

SEQ ID NO: 44 - RNA, 22 nt, Artificial sequence
  >hsa-miR-10a-3p MIMAT0004555 Homo sapiens miR-10a-3p
caaauucguaucuaggggaaua

SEQ ID NO: 45 - RNA, 23 nt, Artificial sequence
  >hsa-miR-10a-5p MIMAT0000253 Homo sapiens miR-10a-5p
uacccuguagauccgaauuugug

SEQ ID NO: 46 - RNA, 22 nt, Artificial sequence
  >hsa-miR-10b-3p MIMAT0004556 Homo sapiens miR-10b-3p
acagauucgauucuaggggaau

SEQ ID NO: 47 - RNA, 23 nt, Artificial sequence
  >hsa-miR-10b-5p MIMAT0000254 Homo sapiens miR-10b-5p
uacccuguagaaccgaauuugug

SEQ ID NO: 48 - RNA, 21 nt, Artificial sequence
  >hsa-miR-1178-3p MIMAT0005823 Homo sapiens miR-1178-3p
uugcucacuguucuucccuag

SEQ ID NO: 49 - RNA, 18 nt, Artificial sequence
  >hsa-miR-1178-5p MIMAT0022940 Homo sapiens miR-1178-5p
cagggucagcugagcaug

SEQ ID NO: 50 - RNA, 21 nt, Artificial sequence
  >hsa-miR-1179 MIMAT0005824 Homo sapiens miR-1179
aagcauucuuucauugguugg

SEQ ID NO: 51 - RNA, 22 nt, Artificial sequence
  >hsa-miR-1180-3p MIMAT0005825 Homo sapiens miR-1180-3p
uuuccggcucgcgugggugugu

SEQ ID NO: 52 - RNA, 21 nt, Artificial sequence
  >hsa-miR-1180-5p MIMAT0026735 Homo sapiens miR-1180-5p
ggacccacccggccgggaaua

SEQ ID NO: 53 - RNA, 21 nt, Artificial sequence
  >hsa-miR-1181 MIMAT0005826 Homo sapiens miR-1181
ccgucgccgccacccgagccg

SEQ ID NO: 54 - RNA, 23 nt, Artificial sequence
  >hsa-miR-1182 MIMAT0005827 Homo sapiens miR-1182
gagggucuugggagggaugugac

SEQ ID NO: 55 - RNA, 27 nt, Artificial sequence
  >hsa-miR-1183 MIMAT0005828 Homo sapiens miR-1183
cacuguaggugauggugagagugggca

SEQ ID NO: 56 - RNA, 23 nt, Artificial sequence
  >hsa-miR-1184 MIMAT0005829 Homo sapiens miR-1184
ccugcagcgacuugauggcuucc

SEQ ID NO: 57 - RNA, 22 nt, Artificial sequence
  >hsa-miR-1185-1-3p MIMAT0022838 Homo sapiens miR-1185-1-3p
auauacagggggagacucuuau

SEQ ID NO: 58 - RNA, 22 nt, Artificial sequence
  >hsa-miR-1185-2-3p MIMAT0022713 Homo sapiens miR-1185-2-3p
auauacagggggagacucucau

SEQ ID NO: 59 - RNA, 21 nt, Artificial sequence
  >hsa-miR-1185-5p MIMAT0005798 Homo sapiens miR-1185-5p
agaggauacccuuuguauguu

SEQ ID NO: 60 - RNA, 23 nt, Artificial sequence
  >hsa-miR-1193 MIMAT0015049 Homo sapiens miR-1193
gggaugguagaccggugacgugc

SEQ ID NO: 61 - RNA, 21 nt, Artificial sequence
  >hsa-miR-1197 MIMAT0005955 Homo sapiens miR-1197
uaggacacauggucuacuucu

SEQ ID NO: 62 - RNA, 21 nt, Artificial sequence
  >hsa-miR-1199-3p MIMAT0031120 Homo sapiens miR-1199-3p
ugcggccggugcucaaccugc

SEQ ID NO: 63 - RNA, 20 nt, Artificial sequence
  >hsa-miR-1199-5p MIMAT0031119 Homo sapiens miR-1199-5p
ccugagcccgggccgcgcag

SEQ ID NO: 64 - RNA, 22 nt, Artificial sequence
  >hsa-miR-1200 MIMAT0005863 Homo sapiens miR-1200
cuccugagccauucugagccuc

SEQ ID NO: 65 - RNA, 21 nt, Artificial sequence
  >hsa-miR-1202 MIMAT0005865 Homo sapiens miR-1202
gugccagcugcagugggggag

SEQ ID NO: 66 - RNA, 21 nt, Artificial sequence
  >hsa-miR-1203 MIMAT0005866 Homo sapiens miR-1203
cccggagccaggaugcagcuc

SEQ ID NO: 67 - RNA, 21 nt, Artificial sequence
  >hsa-miR-1204 MIMAT0005868 Homo sapiens miR-1204
ucguggccuggucuccauuau

SEQ ID NO: 68 - RNA, 20 nt, Artificial sequence
  >hsa-miR-1205 MIMAT0005869 Homo sapiens miR-1205
ucugcaggguuugcuuugag

SEQ ID NO: 69 - RNA, 21 nt, Artificial sequence
  >hsa-miR-1206 MIMAT0005870 Homo sapiens miR-1206
uguucauguagauguuuaagc

SEQ ID NO: 70 - RNA, 18 nt, Artificial sequence
  >hsa-miR-1207-3p MIMAT0005872 Homo sapiens miR-1207-3p
ucagcuggcccucauuuc

SEQ ID NO: 71 - RNA, 21 nt, Artificial sequence
  >hsa-miR-1207-5p MIMAT0005871 Homo sapiens miR-1207-5p
uggcagggaggcugggagggg

SEQ ID NO: 72 - RNA, 20 nt, Artificial sequence
  >hsa-miR-1208 MIMAT0005873 Homo sapiens miR-1208
ucacuguucagacaggcgga

SEQ ID NO: 73 - RNA, 22 nt, Artificial sequence
  >hsa-miR-122-3p MIMAT0004590 Homo sapiens miR-122-3p
aacgccauuaucacacuaaaua

SEQ ID NO: 74 - RNA, 22 nt, Artificial sequence
  >hsa-miR-122-5p MIMAT0000421 Homo sapiens miR-122-5p; hsa_miR-122
uggagugugacaaugguguuug

SEQ ID NO: 75 - RNA, 21 nt, Artificial sequence
  >hsa-miR-1224-3p MIMAT0005459 Homo sapiens miR-1224-3p
ccccaccuccucucuccucag

SEQ ID NO: 76 - RNA, 19 nt, Artificial sequence
  >hsa-miR-1224-5p MIMAT0005458 Homo sapiens miR-1224-5p
gugaggacucgggaggugg

SEQ ID NO: 77 - RNA, 22 nt, Artificial sequence
  >hsa-miR-1225-3p MIMAT0005573 Homo sapiens miR-1225-3p
ugagccccugugccgcccccag

SEQ ID NO: 78 - RNA, 22 nt, Artificial sequence
  >hsa-miR-1225-5p MIMAT0005572 Homo sapiens miR-1225-5p
guggguacggcccagugggggg

SEQ ID NO: 79 - RNA, 22 nt, Artificial sequence
  >hsa-miR-1226-3p MIMAT0005577 Homo sapiens miR-1226-3p
ucaccagcccuguguucccuag

SEQ ID NO: 80 - RNA, 26 nt, Artificial sequence
  >hsa-miR-1226-5p MIMAT0005576 Homo sapiens miR-1226-5p
gugagggcaugcaggccuggaugggg

SEQ ID NO: 81 - RNA, 20 nt, Artificial sequence
  >hsa-miR-1227-3p MIMAT0005580 Homo sapiens miR-1227-3p
cgugccacccuuuuccccag

SEQ ID NO: 82 - RNA, 17 nt, Artificial sequence
  >hsa-miR-1227-5p MIMAT0022941 Homo sapiens miR-1227-5p
guggggccaggcggugg

SEQ ID NO: 83 - RNA, 20 nt, Artificial sequence
  >hsa-miR-1228-3p MIMAT0005583 Homo sapiens miR-1228-3p
ucacaccugccucgcccccc

SEQ ID NO: 84 - RNA, 21 nt, Artificial sequence
  >hsa-miR-1228-5p MIMAT0005582 Homo sapiens miR-1228-5p
gugggcgggggcaggugugug

SEQ ID NO: 85 - RNA, 23 nt, Artificial sequence
  >hsa-miR-1229-3p MIMAT0005584 Homo sapiens miR-1229-3p
cucucaccacugcccucccacag

SEQ ID NO: 86 - RNA, 24 nt, Artificial sequence
  >hsa-miR-1229-5p MIMAT0022942 Homo sapiens miR-1229-5p
guggguaggguuugggggagagcg

SEQ ID NO: 87 - RNA, 20 nt, Artificial sequence
  >hsa-miR-1231 MIMAT0005586 Homo sapiens miR-1231
gugucugggcggacagcugc

SEQ ID NO: 88 - RNA, 20 nt, Artificial sequence
  >hsa-miR-1233-3p MIMAT0005588 Homo sapiens miR-1233-3p
ugagcccuguccucccgcag

SEQ ID NO: 89 - RNA, 22 nt, Artificial sequence
  >hsa-miR-1233-5p MIMAT0022943 Homo sapiens miR-1233-5p
agugggaggccagggcacggca

SEQ ID NO: 90 - RNA, 22 nt, Artificial sequence
  >hsa-miR-1234-3p MIMAT0005589 Homo sapiens miR-1234-3p
ucggccugaccacccaccccac

SEQ ID NO: 91 - RNA, 22 nt, Artificial sequence
  >hsa-miR-1236-3p MIMAT0005591 Homo sapiens miR-1236-3p
ccucuuccccuugucucuccag

SEQ ID NO: 92 - RNA, 22 nt, Artificial sequence
  >hsa-miR-1236-5p MIMAT0022945 Homo sapiens miR-1236-5p
ugagugacaggggaaaugggga

SEQ ID NO: 93 - RNA, 21 nt, Artificial sequence
  >hsa-miR-1237-3p MIMAT0005592 Homo sapiens miR-1237-3p
uccuucugcuccgucccccag

SEQ ID NO: 94 - RNA, 21 nt, Artificial sequence
  >hsa-miR-1237-5p MIMAT0022946 Homo sapiens miR-1237-5p
cgggggcggggccgaagcgcg

SEQ ID NO: 95 - RNA, 20 nt, Artificial sequence
  >hsa-miR-1238-3p MIMAT0005593 Homo sapiens miR-1238-3p
cuuccucgucugucugcccc

SEQ ID NO: 96 - RNA, 23 nt, Artificial sequence
  >hsa-miR-1238-5p MIMAT0022947 Homo sapiens miR-1238-5p
gugagugggagccccagugugug

SEQ ID NO: 97 - RNA, 20 nt, Artificial sequence
  >hsa-miR-124-3p MIMAT0000422 Homo sapiens miR-124-3p
uaaggcacgcggugaaugcc

SEQ ID NO: 98 - RNA, 22 nt, Artificial sequence
  >hsa-miR-124-5p MIMAT0004591 Homo sapiens miR-124-5p
cguguucacagcggaccuugau

SEQ ID NO: 99 - RNA, 22 nt, Artificial sequence
  >hsa-miR-1243 MIMAT0005894 Homo sapiens miR-1243
aacuggaucaauuauaggagug

SEQ ID NO: 100 - RNA, 26 nt, Artificial sequence
  >hsa-miR-1244 MIMAT0005896 Homo sapiens miR-1244
aaguaguugguuuguaugagaugguu

SEQ ID NO: 101 - RNA, 21 nt, Artificial sequence
  >hsa-miR-1245a MIMAT0005897 Homo sapiens miR-1245a
aagugaucuaaaggccuacau

SEQ ID NO: 102 - RNA, 22 nt, Artificial sequence
  >hsa-miR-1245b-3p MIMAT0019951 Homo sapiens miR-1245b-3p
ucagaugaucuaaaggccuaua

SEQ ID NO: 103 - RNA, 21 nt, Artificial sequence
  >hsa-miR-1245b-5p MIMAT0019950 Homo sapiens miR-1245b-5p
uaggccuuuagaucacuuaaa

SEQ ID NO: 104 - RNA, 19 nt, Artificial sequence
  >hsa-miR-1246 MIMAT0005898 Homo sapiens miR-1246
aauggauuuuuggagcagg

SEQ ID NO: 105 - RNA, 24 nt, Artificial sequence
  >hsa-miR-1247-3p MIMAT0022721 Homo sapiens miR-1247-3p
ccccgggaacgucgagacuggagc

SEQ ID NO: 106 - RNA, 22 nt, Artificial sequence
  >hsa-miR-1247-5p MIMAT0005899 Homo sapiens miR-1247-5p
acccgucccguucguccccgga

SEQ ID NO: 107 - RNA, 27 nt, Artificial sequence
  >hsa-miR-1248 MIMAT0005900 Homo sapiens miR-1248
accuucuuguauaagcacugugcuaaa

SEQ ID NO: 108 - RNA, 22 nt, Artificial sequence
  >hsa-miR-1249-3p MIMAT0005901 Homo sapiens miR-1249-3p
acgcccuucccccccuucuuca

SEQ ID NO: 109 - RNA, 24 nt, Artificial sequence
  >hsa-miR-1249-5p MIMAT0032029 Homo sapiens miR-1249-5p
aggagggaggagaugggccaaguu

SEQ ID NO: 110 - RNA, 19 nt, Artificial sequence
  >hsa-miR-1250-3p MIMAT0026740 Homo sapiens miR-1250-3p
acauuuuccagcccauuca

SEQ ID NO: 111 - RNA, 21 nt, Artificial sequence
  >hsa-miR-1250-5p MIMAT0005902 Homo sapiens miR-1250-5p
acggugcuggauguggccuuu

SEQ ID NO: 112 - RNA, 21 nt, Artificial sequence
  >hsa-miR-1251-3p MIMAT0026741 Homo sapiens miR-1251-3p
cgcuuugcucagccaguguag

SEQ ID NO: 113 - RNA, 21 nt, Artificial sequence
  >hsa-miR-1251-5p MIMAT0005903 Homo sapiens miR-1251-5p
acucuagcugccaaaggcgcu

SEQ ID NO: 114 - RNA, 22 nt, Artificial sequence
  >hsa-miR-1252-3p MIMAT0026744 Homo sapiens miR-1252-3p
caaaugagcuuaauuuccuuuu

SEQ ID NO: 115 - RNA, 22 nt, Artificial sequence
  >hsa-miR-1252-5p MIMAT0005944 Homo sapiens miR-1252-5p
agaaggaaauugaauucauuua

SEQ ID NO: 116 - RNA, 21 nt, Artificial sequence
  >hsa-miR-1253 MIMAT0005904 Homo sapiens miR-1253
agagaagaagaucagccugca

SEQ ID NO: 117 - RNA, 24 nt, Artificial sequence
  >hsa-miR-1254 MIMAT0005905 Homo sapiens miR-1254
agccuggaagcuggagccugcagu

SEQ ID NO: 118 - RNA, 23 nt, Artificial sequence
  >hsa-miR-1255a MIMAT0005906 Homo sapiens miR-1255a
aggaugagcaaagaaaguagauu

SEQ ID NO: 119 - RNA, 22 nt, Artificial sequence
  >hsa-miR-1255b-2-3p MIMAT0022725 Homo sapiens miR-1255b-2-3p
aaccacuuucuuugcucaucca

SEQ ID NO: 120 - RNA, 22 nt, Artificial sequence
  >hsa-miR-1255b-5p MIMAT0005945 Homo sapiens miR-1255b-5p
cggaugagcaaagaaagugguu

SEQ ID NO: 121 - RNA, 22 nt, Artificial sequence
  >hsa-miR-1256 MIMAT0005907 Homo sapiens miR-1256
aggcauugacuucucacuagcu

SEQ ID NO: 122 - RNA, 21 nt, Artificial sequence
  >hsa-miR-1257 MIMAT0005908 Homo sapiens miR-1257
agugaaugauggguucugacc

SEQ ID NO: 123 - RNA, 21 nt, Artificial sequence
  >hsa-miR-1258 MIMAT0005909 Homo sapiens miR-1258
aguuaggauuaggucguggaa

SEQ ID NO: 124 - RNA, 22 nt, Artificial sequence
  >hsa-miR-125a-3p MIMAT0004602 Homo sapiens miR-125a-3p
acaggugagguucuugggagcc

SEQ ID NO: 125 - RNA, 24 nt, Artificial sequence
  >hsa-miR-125a-5p MIMAT0000443 Homo sapiens miR-125a-5p
ucccugagacccuuuaaccuguga

SEQ ID NO: 126 - RNA, 22 nt, Artificial sequence
  >hsa-miR-125b-1-3p MIMAT0004592 Homo sapiens miR-125b-1-3p
acggguuaggcucuugggagcu

SEQ ID NO: 127 - RNA, 22 nt, Artificial sequence
  >hsa-miR-125b-2-3p MIMAT0004603 Homo sapiens miR-125b-2-3p
ucacaagucaggcucuugggac

SEQ ID NO: 128 - RNA, 22 nt, Artificial sequence
  >hsa-miR-125b-5p MIMAT0000423 Homo sapiens miR-125b-5p
ucccugagacccuaacuuguga

SEQ ID NO: 129 - RNA, 22 nt, Artificial sequence
  >hsa-miR-126-3p MIMAT0000445 Homo sapiens miR-126-3p
ucguaccgugaguaauaaugcg

SEQ ID NO: 130 - RNA, 21 nt, Artificial sequence
  >hsa-miR-126-5p MIMAT0000444 Homo sapiens miR-126-5p
cauuauuacuuuugguacgcg

SEQ ID NO: 131 - RNA, 18 nt, Artificial sequence
  >hsa-miR-1260a MIMAT0005911 Homo sapiens miR-1260a
aucccaccucugccacca

SEQ ID NO: 132 - RNA, 19 nt, Artificial sequence
  >hsa-miR-1260b MIMAT0015041 Homo sapiens miR-1260b
aucccaccacugccaccau

SEQ ID NO: 133 - RNA, 19 nt, Artificial sequence
  >hsa-miR-1261 MIMAT0005913 Homo sapiens miR-1261
auggauaaggcuuuggcuu

SEQ ID NO: 134 - RNA, 22 nt, Artificial sequence
  >hsa-miR-1262 MIMAT0005914 Homo sapiens miR-1262
augggugaauuuguagaaggau

SEQ ID NO: 135 - RNA, 22 nt, Artificial sequence
  >hsa-miR-1263 MIMAT0005915 Homo sapiens miR-1263
augguacccuggcauacugagu

SEQ ID NO: 136 - RNA, 23 nt, Artificial sequence
  >hsa-miR-1264 MIMAT0005791 Homo sapiens miR-1264
caagucuuauuugagcaccuguu

SEQ ID NO: 137 - RNA, 22 nt, Artificial sequence
  >hsa-miR-1265 MIMAT0005918 Homo sapiens miR-1265
caggauguggucaaguguuguu

SEQ ID NO: 138 - RNA, 22 nt, Artificial sequence
  >hsa-miR-1266-3p MIMAT0026742 Homo sapiens miR-1266-3p
cccuguucuaugcccugaggga

SEQ ID NO: 139 - RNA, 23 nt, Artificial sequence
  >hsa-miR-1266-5p MIMAT0005920 Homo sapiens miR-1266-5p
ccucagggcuguagaacagggcu

SEQ ID NO: 140 - RNA, 21 nt, Artificial sequence
  >hsa-miR-1267 MIMAT0005921 Homo sapiens miR-1267
ccuguugaaguguaaucccca

SEQ ID NO: 141 - RNA, 18 nt, Artificial sequence
  >hsa-miR-1268a MIMAT0005922 Homo sapiens miR-1268a
cgggcguggugguggggg

SEQ ID NO: 142 - RNA, 20 nt, Artificial sequence
  >hsa-miR-1268b MIMAT0018925 Homo sapiens miR-1268b
cgggcgugguggugggggug

SEQ ID NO: 143 - RNA, 22 nt, Artificial sequence
  >hsa-miR-1269a MIMAT0005923 Homo sapiens miR-1269a
cuggacugagccgugcuacugg

SEQ ID NO: 144 - RNA, 22 nt, Artificial sequence
  >hsa-miR-1269b MIMAT0019059 Homo sapiens miR-1269b
cuggacugagccaugcuacugg

SEQ ID NO: 145 - RNA, 22 nt, Artificial sequence
  >hsa-miR-127-3p MIMAT0000446 Homo sapiens miR-127-3p
ucggauccgucugagcuuggcu

SEQ ID NO: 146 - RNA, 22 nt, Artificial sequence
  >hsa-miR-127-5p MIMAT0004604 Homo sapiens miR-127-5p
cugaagcucagagggcucugau

SEQ ID NO: 147 - RNA, 23 nt, Artificial sequence
  >hsa-miR-1270 MIMAT0005924 Homo sapiens miR-1270
cuggagauauggaagagcugugu

SEQ ID NO: 148 - RNA, 22 nt, Artificial sequence
  >hsa-miR-1271-3p MIMAT0022712 Homo sapiens miR-1271-3p
agugccugcuaugugccaggca

SEQ ID NO: 149 - RNA, 22 nt, Artificial sequence
  >hsa-miR-1271-5p MIMAT0005796 Homo sapiens miR-1271-5p
cuuggcaccuagcaagcacuca

SEQ ID NO: 150 - RNA, 26 nt, Artificial sequence
  >hsa-miR-1272 MIMAT0005925 Homo sapiens miR-1272
gaugaugauggcagcaaauucugaaa

SEQ ID NO: 151 - RNA, 25 nt, Artificial sequence
  >hsa-miR-1273a MIMAT0005926 Homo sapiens miR-1273a
gggcgacaaagcaagacucuuucuu

SEQ ID NO: 152 - RNA, 22 nt, Artificial sequence
  >hsa-miR-1273c MIMAT0015017 Homo sapiens miR-1273c
ggcgacaaaacgagacccuguc

SEQ ID NO: 153 - RNA, 25 nt, Artificial sequence
  >hsa-miR-1273d MIMAT0015090 Homo sapiens miR-1273d
gaacccaugagguugaggcugcagu

SEQ ID NO: 154 - RNA, 22 nt, Artificial sequence
  >hsa-miR-1273e MIMAT0018079 Homo sapiens miR-1273e
uugcuugaacccaggaagugga

SEQ ID NO: 155 - RNA, 19 nt, Artificial sequence
  >hsa-miR-1273f MIMAT0020601 Homo sapiens miR-1273f
ggagauggagguugcagug

SEQ ID NO: 156 - RNA, 21 nt, Artificial sequence
  >hsa-miR-1273g-3p MIMAT0022742 Homo sapiens miR-1273g-3p
accacugcacuccagccugag

SEQ ID NO: 157 - RNA, 22 nt, Artificial sequence
  >hsa-miR-1273g-5p MIMAT0020602 Homo sapiens miR-1273g-5p
ggugguugaggcugcaguaagu

SEQ ID NO: 158 - RNA, 22 nt, Artificial sequence
  >hsa-miR-1273h-3p MIMAT0030416 Homo sapiens miR-1273h-3p
cugcagacucgaccucccaggc

SEQ ID NO: 159 - RNA, 21 nt, Artificial sequence
  >hsa-miR-1273h-5p MIMAT0030415 Homo sapiens miR-1273h-5p
cugggaggucaaggcugcagu

SEQ ID NO: 160 - RNA, 17 nt, Artificial sequence
  >hsa-miR-1275 MIMAT0005929 Homo sapiens miR-1275
gugggggagaggcuguc

SEQ ID NO: 161 - RNA, 20 nt, Artificial sequence
  >hsa-miR-1276 MIMAT0005930 Homo sapiens miR-1276
uaaagagcccuguggagaca

SEQ ID NO: 162 - RNA, 22 nt, Artificial sequence
  >hsa-miR-1277-3p MIMAT0005933 Homo sapiens miR-1277-3p
uacguagauauauauguauuuu

SEQ ID NO: 163 - RNA, 24 nt, Artificial sequence
  >hsa-miR-1277-5p MIMAT0022724 Homo sapiens miR-1277-5p
aaauauauauauauauguacguau

SEQ ID NO: 164 - RNA, 22 nt, Artificial sequence
  >hsa-miR-1278 MIMAT0005936 Homo sapiens miR-1278
uaguacugugcauaucaucuau

SEQ ID NO: 165 - RNA, 17 nt, Artificial sequence
  >hsa-miR-1279 MIMAT0005937 Homo sapiens miR-1279
ucauauugcuucuuucu

SEQ ID NO: 166 - RNA, 23 nt, Artificial sequence
  >hsa-miR-128-1-5p MIMAT0026477 Homo sapiens miR-128-1-5p
cggggccguagcacugucugaga

SEQ ID NO: 167 - RNA, 23 nt, Artificial sequence
  >hsa-miR-128-2-5p MIMAT0031095 Homo sapiens miR-128-2-5p
gggggccgauacacuguacgaga

SEQ ID NO: 168 - RNA, 21 nt, Artificial sequence
  >hsa-miR-128-3p MIMAT0000424 Homo sapiens miR-128-3p
ucacagugaaccggucucuuu

SEQ ID NO: 169 - RNA, 17 nt, Artificial sequence
  >hsa-miR-1281 MIMAT0005939 Homo sapiens miR-1281
ucgccuccuccucuccc

SEQ ID NO: 170 - RNA, 20 nt, Artificial sequence
  >hsa-miR-1282 MIMAT0005940 Homo sapiens miR-1282
ucguuugccuuuuucugcuu

SEQ ID NO: 171 - RNA, 22 nt, Artificial sequence
  >hsa-miR-1283 MIMAT0005799 Homo sapiens miR-1283
ucuacaaaggaaagcgcuuucu

SEQ ID NO: 172 - RNA, 22 nt, Artificial sequence
  >hsa-miR-1284 MIMAT0005941 Homo sapiens miR-1284
ucuauacagacccuggcuuuuc

SEQ ID NO: 173 - RNA, 22 nt, Artificial sequence
  >hsa-miR-1285-3p MIMAT0005876 Homo sapiens miR-1285-3p
ucugggcaacaaagugagaccu

SEQ ID NO: 174 - RNA, 21 nt, Artificial sequence
  >hsa-miR-1285-5p MIMAT0022719 Homo sapiens miR-1285-5p
gaucucacuuuguugcccagg

SEQ ID NO: 175 - RNA, 21 nt, Artificial sequence
  >hsa-miR-1286 MIMAT0005877 Homo sapiens miR-1286
ugcaggaccaagaugagcccu

SEQ ID NO: 176 - RNA, 22 nt, Artificial sequence
  >hsa-miR-1287-3p MIMAT0026738 Homo sapiens miR-1287-3p
cucuagccacagaugcagugau

SEQ ID NO: 177 - RNA, 22 nt, Artificial sequence
  >hsa-miR-1287-5p MIMAT0005878 Homo sapiens miR-1287-5p
ugcuggaucagugguucgaguc

SEQ ID NO: 178 - RNA, 21 nt, Artificial sequence
  >hsa-miR-1288-3p MIMAT0005942 Homo sapiens miR-1288-3p
uggacugcccugaucuggaga

SEQ ID NO: 179 - RNA, 23 nt, Artificial sequence
  >hsa-miR-1288-5p MIMAT0026743 Homo sapiens miR-1288-5p
gcagaucaggacuguaacucacc

SEQ ID NO: 180 - RNA, 23 nt, Artificial sequence
  >hsa-miR-1289 MIMAT0005879 Homo sapiens miR-1289
uggaguccaggaaucugcauuuu

SEQ ID NO: 181 - RNA, 22 nt, Artificial sequence
  >hsa-miR-129-1-3p MIMAT0004548 Homo sapiens miR-129-1-3p
aagcccuuaccccaaaaaguau

SEQ ID NO: 182 - RNA, 22 nt, Artificial sequence
  >hsa-miR-129-2-3p MIMAT0004605 Homo sapiens miR-129-2-3p
aagcccuuaccccaaaaagcau

SEQ ID NO: 183 - RNA, 21 nt, Artificial sequence
  >hsa-miR-129-5p MIMAT0000242 Homo sapiens miR-129-5p
cuuuuugcggucugggcuugc

SEQ ID NO: 184 - RNA, 19 nt, Artificial sequence
  >hsa-miR-1290 MIMAT0005880 Homo sapiens miR-1290
uggauuuuuggaucaggga

SEQ ID NO: 185 - RNA, 24 nt, Artificial sequence
  >hsa-miR-1291 MIMAT0005881 Homo sapiens miR-1291
uggcccugacugaagaccagcagu

SEQ ID NO: 186 - RNA, 20 nt, Artificial sequence
  >hsa-miR-1292-3p MIMAT0022948 Homo sapiens miR-1292-3p
ucgcgccccggcucccguuc

SEQ ID NO: 187 - RNA, 25 nt, Artificial sequence
  >hsa-miR-1292-5p MIMAT0005943 Homo sapiens miR-1292-5p
ugggaacggguuccggcagacgcug

SEQ ID NO: 188 - RNA, 22 nt, Artificial sequence
  >hsa-miR-1293 MIMAT0005883 Homo sapiens miR-1293
uggguggucuggagauuugugc

SEQ ID NO: 189 - RNA, 22 nt, Artificial sequence
  >hsa-miR-1294 MIMAT0005884 Homo sapiens miR-1294
ugugagguuggcauuguugucu

SEQ ID NO: 190 - RNA, 21 nt, Artificial sequence
  >hsa-miR-1295a MIMAT0005885 Homo sapiens miR-1295a
uuaggccgcagaucuggguga

SEQ ID NO: 191 - RNA, 22 nt, Artificial sequence
  >hsa-miR-1295b-3p MIMAT0022294 Homo sapiens miR-1295b-3p
aauaggccacggaucugggcaa

SEQ ID NO: 192 - RNA, 21 nt, Artificial sequence
  >hsa-miR-1295b-5p MIMAT0022293 Homo sapiens miR-1295b-5p
cacccagaucugcggccuaau

SEQ ID NO: 193 - RNA, 22 nt, Artificial sequence
  >hsa-miR-1296-3p MIMAT0026637 Homo sapiens miR-1296-3p
gaguggggcuucgacccuaacc

SEQ ID NO: 194 - RNA, 22 nt, Artificial sequence
  >hsa-miR-1296-5p MIMAT0005794 Homo sapiens miR-1296-5p
uuagggcccuggcuccaucucc

SEQ ID NO: 195 - RNA, 17 nt, Artificial sequence
  >hsa-miR-1297 MIMAT0005886 Homo sapiens miR-1297
uucaaguaauucaggug

SEQ ID NO: 196 - RNA, 21 nt, Artificial sequence
  >hsa-miR-1298-3p MIMAT0026641 Homo sapiens miR-1298-3p
caucugggcaacugacugaac

SEQ ID NO: 197 - RNA, 22 nt, Artificial sequence
  >hsa-miR-1298-5p MIMAT0005800 Homo sapiens miR-1298-5p
uucauucggcuguccagaugua

SEQ ID NO: 198 - RNA, 22 nt, Artificial sequence
  >hsa-miR-1299 MIMAT0005887 Homo sapiens miR-1299
uucuggaauucugugugaggga

SEQ ID NO: 199 - RNA, 24 nt, Artificial sequence
  >hsa-miR-1301-3p MIMAT0005797 Homo sapiens miR-1301-3p
uugcagcugccugggagugacuuc

SEQ ID NO: 200 - RNA, 19 nt, Artificial sequence
  >hsa-miR-1301-5p MIMAT0026639 Homo sapiens miR-1301-5p
cgcucuaggcaccgcagca

SEQ ID NO: 201 - RNA, 21 nt, Artificial sequence
  >hsa-miR-1302 MIMAT0005890 Homo sapiens miR-1302
uugggacauacuuaugcuaaa

SEQ ID NO: 202 - RNA, 22 nt, Artificial sequence
  >hsa-miR-1303 MIMAT0005891 Homo sapiens miR-1303
uuuagagacggggucuugcucu

SEQ ID NO: 203 - RNA, 22 nt, Artificial sequence
  >hsa-miR-1304-3p MIMAT0022720 Homo sapiens miR-1304-3p
ucucacuguagccucgaacccc

SEQ ID NO: 204 - RNA, 22 nt, Artificial sequence
  >hsa-miR-1304-5p MIMAT0005892 Homo sapiens miR-1304-5p
uuugaggcuacagugagaugug

SEQ ID NO: 205 - RNA, 22 nt, Artificial sequence
  >hsa-miR-1305 MIMAT0005893 Homo sapiens miR-1305
uuuucaacucuaaugggagaga

SEQ ID NO: 206 - RNA, 18 nt, Artificial sequence
  >hsa-miR-1306-3p MIMAT0005950 Homo sapiens miR-1306-3p
acguuggcucugguggug

SEQ ID NO: 207 - RNA, 22 nt, Artificial sequence
  >hsa-miR-1306-5p MIMAT0022726 Homo sapiens miR-1306-5p
ccaccuccccugcaaacgucca

SEQ ID NO: 208 - RNA, 22 nt, Artificial sequence
  >hsa-miR-1307-3p MIMAT0005951 Homo sapiens miR-1307-3p
acucggcguggcgucggucgug

SEQ ID NO: 209 - RNA, 21 nt, Artificial sequence
  >hsa-miR-1307-5p MIMAT0022727 Homo sapiens miR-1307-5p
ucgaccggaccucgaccggcu

SEQ ID NO: 210 - RNA, 22 nt, Artificial sequence
  >hsa-miR-130a-3p MIMAT0000425 Homo sapiens miR-130a-3p
cagugcaauguuaaaagggcau

SEQ ID NO: 211 - RNA, 22 nt, Artificial sequence
  >hsa-miR-130a-5p MIMAT0004593 Homo sapiens miR-130a-5p
uucacauugugcuacugucugc

SEQ ID NO: 212 - RNA, 22 nt, Artificial sequence
  >hsa-miR-130b-3p MIMAT0000691 Homo sapiens miR-130b-3p
cagugcaaugaugaaagggcau

SEQ ID NO: 213 - RNA, 21 nt, Artificial sequence
  >hsa-miR-130b-5p MIMAT0004680 Homo sapiens miR-130b-5p
acucuuucccuguugcacuac

SEQ ID NO: 214 - RNA, 22 nt, Artificial sequence
  >hsa-miR-132-3p MIMAT0000426 Homo sapiens miR-132-3p
uaacagucuacagccauggucg

SEQ ID NO: 215 - RNA, 22 nt, Artificial sequence
  >hsa-miR-132-5p MIMAT0004594 Homo sapiens miR-132-5p
accguggcuuucgauuguuacu

SEQ ID NO: 216 - RNA, 18 nt, Artificial sequence
  >hsa-miR-1321 MIMAT0005952 Homo sapiens miR-1321
cagggaggugaaugugau

SEQ ID NO: 217 - RNA, 19 nt, Artificial sequence
  >hsa-miR-1322 MIMAT0005953 Homo sapiens miR-1322
gaugaugcugcugaugcug

SEQ ID NO: 218 - RNA, 22 nt, Artificial sequence
  >hsa-miR-1323 MIMAT0005795 Homo sapiens miR-1323
ucaaaacugaggggcauuuucu

SEQ ID NO: 219 - RNA, 24 nt, Artificial sequence
  >hsa-miR-1324 MIMAT0005956 Homo sapiens miR-1324
ccagacagaauucuaugcacuuuc

SEQ ID NO: 220 - RNA, 22 nt, Artificial sequence
  >hsa-miR-133a-3p MIMAT0000427 Homo sapiens miR-133a-3p
uuugguccccuucaaccagcug

SEQ ID NO: 221 - RNA, 22 nt, Artificial sequence
  >hsa-miR-133a-5p MIMAT0026478 Homo sapiens miR-133a-5p
agcugguaaaauggaaccaaau

SEQ ID NO: 222 - RNA, 22 nt, Artificial sequence
  >hsa-miR-133b MIMAT0000770 Homo sapiens miR-133b
uuugguccccuucaaccagcua

SEQ ID NO: 223 - RNA, 23 nt, Artificial sequence
  >hsa-miR-134-3p MIMAT0026481 Homo sapiens miR-134-3p
ccugugggccaccuagucaccaa

SEQ ID NO: 224 - RNA, 22 nt, Artificial sequence
  >hsa-miR-134-5p MIMAT0000447 Homo sapiens miR-134-5p
ugugacugguugaccagagggg

SEQ ID NO: 225 - RNA, 22 nt, Artificial sequence
  >hsa-miR-1343-3p MIMAT0019776 Homo sapiens miR-1343-3p
cuccuggggcccgcacucucgc

SEQ ID NO: 226 - RNA, 22 nt, Artificial sequence
  >hsa-miR-1343-5p MIMAT0027038 Homo sapiens miR-1343-5p
uggggagcggcccccggguggg

SEQ ID NO: 227 - RNA, 22 nt, Artificial sequence
  >hsa-miR-135a-3p MIMAT0004595 Homo sapiens miR-135a-3p
uauagggauuggagccguggcg

SEQ ID NO: 228 - RNA, 23 nt, Artificial sequence
  >hsa-miR-135a-5p MIMAT0000428 Homo sapiens miR-135a-5p
uauggcuuuuuauuccuauguga

SEQ ID NO: 229 - RNA, 22 nt, Artificial sequence
  >hsa-miR-135b-3p MIMAT0004698 Homo sapiens miR-135b-3p
auguagggcuaaaagccauggg

SEQ ID NO: 230 - RNA, 23 nt, Artificial sequence
  >hsa-miR-135b-5p MIMAT0000758 Homo sapiens miR-135b-5p
uauggcuuuucauuccuauguga

SEQ ID NO: 231 - RNA, 22 nt, Artificial sequence
  >hsa-miR-136-3p MIMAT0004606 Homo sapiens miR-136-3p
caucaucgucucaaaugagucu

SEQ ID NO: 232 - RNA, 23 nt, Artificial sequence
  >hsa-miR-136-5p MIMAT0000448 Homo sapiens miR-136-5p
acuccauuuguuuugaugaugga

SEQ ID NO: 233 - RNA, 23 nt, Artificial sequence
  >hsa-miR-137 MIMAT0000429 Homo sapiens miR-137
uuauugcuuaagaauacgcguag

SEQ ID NO: 234 - RNA, 22 nt, Artificial sequence
  >hsa-miR-138-1-3p MIMAT0004607 Homo sapiens miR-138-1-3p
gcuacuucacaacaccagggcc

SEQ ID NO: 235 - RNA, 22 nt, Artificial sequence
  >hsa-miR-138-2-3p MIMAT0004596 Homo sapiens miR-138-2-3p
gcuauuucacgacaccaggguu

SEQ ID NO: 236 - RNA, 23 nt, Artificial sequence
  >hsa-miR-138-5p MIMAT0000430 Homo sapiens miR-138-5p
agcugguguugugaaucaggccg

SEQ ID NO: 237 - RNA, 23 nt, Artificial sequence
  >hsa-miR-139-3p MIMAT0004552 Homo sapiens miR-139-3p
uggagacgcggcccuguuggagu

SEQ ID NO: 238 - RNA, 23 nt, Artificial sequence
  >hsa-miR-139-5p MIMAT0000250 Homo sapiens miR-139-5p
ucuacagugcacgugucuccagu

SEQ ID NO: 239 - RNA, 21 nt, Artificial sequence
  >hsa-miR-140-3p MIMAT0004597 Homo sapiens miR-140-3p
uaccacaggguagaaccacgg

SEQ ID NO: 240 - RNA, 22 nt, Artificial sequence
  >hsa-miR-140-5p MIMAT0000431 Homo sapiens miR-140-5p
cagugguuuuacccuaugguag

SEQ ID NO: 241 - RNA, 22 nt, Artificial sequence
  >hsa-miR-141-3p MIMAT0000432 Homo sapiens miR-141-3p
uaacacugucugguaaagaugg

SEQ ID NO: 242 - RNA, 22 nt, Artificial sequence
  >hsa-miR-141-5p MIMAT0004598 Homo sapiens miR-141-5p
caucuuccaguacaguguugga

SEQ ID NO: 243 - RNA, 23 nt, Artificial sequence
  >hsa-miR-142-3p MIMAT0000434 Homo sapiens miR-142-3p
uguaguguuuccuacuuuaugga

SEQ ID NO: 244 - RNA, 21 nt, Artificial sequence
  >hsa-miR-142-5p MIMAT0000433 Homo sapiens miR-142-5p
cauaaaguagaaagcacuacu

SEQ ID NO: 245 - RNA, 21 nt, Artificial sequence
  >hsa-miR-143-3p MIMAT0000435 Homo sapiens miR-143-3p
ugagaugaagcacuguagcuc

SEQ ID NO: 246 - RNA, 22 nt, Artificial sequence
  >hsa-miR-143-5p MIMAT0004599 Homo sapiens miR-143-5p
ggugcagugcugcaucucuggu

SEQ ID NO: 247 - RNA, 20 nt, Artificial sequence
  >hsa-miR-144-3p MIMAT0000436 Homo sapiens miR-144-3p
uacaguauagaugauguacu

SEQ ID NO: 248 - RNA, 22 nt, Artificial sequence
  >hsa-miR-144-5p MIMAT0004600 Homo sapiens miR-144-5p
ggauaucaucauauacuguaag

SEQ ID NO: 249 - RNA, 22 nt, Artificial sequence
  >hsa-miR-145-3p MIMAT0004601 Homo sapiens miR-145-3p
ggauuccuggaaauacuguucu

SEQ ID NO: 250 - RNA, 23 nt, Artificial sequence
  >hsa-miR-145-5p MIMAT0000437 Homo sapiens miR-145-5p
guccaguuuucccaggaaucccu

SEQ ID NO: 251 - RNA, 22 nt, Artificial sequence
  >hsa-miR-1468-3p MIMAT0026638 Homo sapiens miR-1468-3p
agcaaaauaagcaaauggaaaa

SEQ ID NO: 252 - RNA, 21 nt, Artificial sequence
  >hsa-miR-1468-5p MIMAT0006789 Homo sapiens miR-1468-5p
cuccguuugccuguuucgcug

SEQ ID NO: 253 - RNA, 22 nt, Artificial sequence
  >hsa-miR-1469 MIMAT0007347 Homo sapiens miR-1469
cucggcgcggggcgcgggcucc

SEQ ID NO: 254 - RNA, 22 nt, Artificial sequence
  >hsa-miR-146a-3p MIMAT0004608 Homo sapiens miR-146a-3p
ccucugaaauucaguucuucag

SEQ ID NO: 255 - RNA, 22 nt, Artificial sequence
  >hsa-miR-146a-5p MIMAT0000449 Homo sapiens miR-146a-5p
ugagaacugaauuccauggguu

SEQ ID NO: 256 - RNA, 22 nt, Artificial sequence
  >hsa-miR-146b-3p MIMAT0004766 Homo sapiens miR-146b-3p
ugcccuguggacucaguucugg

SEQ ID NO: 257 - RNA, 22 nt, Artificial sequence
  >hsa-miR-146b-5p MIMAT0002809 Homo sapiens miR-146b-5p
ugagaacugaauuccauaggcu

SEQ ID NO: 258 - RNA, 21 nt, Artificial sequence
  >hsa-miR-1470 MIMAT0007348 Homo sapiens miR-1470
gcccuccgcccgugcaccccg

SEQ ID NO: 259 - RNA, 22 nt, Artificial sequence
  >hsa-miR-1471 MIMAT0007349 Homo sapiens miR-1471
gcccgcguguggagccaggugu

SEQ ID NO: 260 - RNA, 20 nt, Artificial sequence
  >hsa-miR-147a MIMAT0000251 Homo sapiens miR-147a
guguguggaaaugcuucugc

SEQ ID NO: 261 - RNA, 22 nt, Artificial sequence
  >hsa-miR-147b MIMAT0004928 Homo sapiens miR-147b
gugugcggaaaugcuucugcua

SEQ ID NO: 262 - RNA, 22 nt, Artificial sequence
  >hsa-miR-148a-3p MIMAT0000243 Homo sapiens miR-148a-3p
ucagugcacuacagaacuuugu

SEQ ID NO: 263 - RNA, 22 nt, Artificial sequence
  >hsa-miR-148a-5p MIMAT0004549 Homo sapiens miR-148a-5p
aaaguucugagacacuccgacu

SEQ ID NO: 264 - RNA, 22 nt, Artificial sequence
  >hsa-miR-148b-3p MIMAT0000759 Homo sapiens miR-148b-3p
ucagugcaucacagaacuuugu

SEQ ID NO: 265 - RNA, 22 nt, Artificial sequence
  >hsa-miR-148b-5p MIMAT0004699 Homo sapiens miR-148b-5p
aaguucuguuauacacucaggc

SEQ ID NO: 266 - RNA, 21 nt, Artificial sequence
  >hsa-miR-149-3p MIMAT0004609 Homo sapiens miR-149-3p
agggagggacgggggcugugc

SEQ ID NO: 267 - RNA, 23 nt, Artificial sequence
  >hsa-miR-149-5p MIMAT0000450 Homo sapiens miR-149-5p
ucuggcuccgugucuucacuccc

SEQ ID NO: 268 - RNA, 22 nt, Artificial sequence
  >hsa-miR-150-3p MIMAT0004610 Homo sapiens miR-150-3p
cugguacaggccugggggacag

SEQ ID NO: 269 - RNA, 22 nt, Artificial sequence
  >hsa-miR-150-5p MIMAT0000451 Homo sapiens miR-150-5p
ucucccaacccuuguaccagug

SEQ ID NO: 270 - RNA, 21 nt, Artificial sequence
  >hsa-miR-151a-3p MIMAT0000757 Homo sapiens miR-151a-3p
cuagacugaagcuccuugagg

SEQ ID NO: 271 - RNA, 21 nt, Artificial sequence
  >hsa-miR-151a-5p MIMAT0004697 Homo sapiens miR-151a-5p
ucgaggagcucacagucuagu

SEQ ID NO: 272 - RNA, 18 nt, Artificial sequence
  >hsa-miR-151b MIMAT0010214 Homo sapiens miR-151b
ucgaggagcucacagucu

SEQ ID NO: 273 - RNA, 21 nt, Artificial sequence
  >hsa-miR-152-3p MIMAT0000438 Homo sapiens miR-152-3p
ucagugcaugacagaacuugg

SEQ ID NO: 274 - RNA, 23 nt, Artificial sequence
  >hsa-miR-152-5p MIMAT0026479 Homo sapiens miR-152-5p
agguucugugauacacuccgacu

SEQ ID NO: 275 - RNA, 22 nt, Artificial sequence
  >hsa-miR-153-3p MIMAT0000439 Homo sapiens miR-153-3p
uugcauagucacaaaagugauc

SEQ ID NO: 276 - RNA, 22 nt, Artificial sequence
  >hsa-miR-153-5p MIMAT0026480 Homo sapiens miR-153-5p
ucauuuuugugauguugcagcu

SEQ ID NO: 277 - RNA, 22 nt, Artificial sequence
  >hsa-miR-1537-3p MIMAT0007399 Homo sapiens miR-1537-3p
aaaaccgucuaguuacaguugu

SEQ ID NO: 278 - RNA, 22 nt, Artificial sequence
  >hsa-miR-1537-5p MIMAT0026765 Homo sapiens miR-1537-5p
agcuguaauuagucaguuuucu

SEQ ID NO: 279 - RNA, 23 nt, Artificial sequence
  >hsa-miR-1538 MIMAT0007400 Homo sapiens miR-1538
cggcccgggcugcugcuguuccu

SEQ ID NO: 280 - RNA, 21 nt, Artificial sequence
  >hsa-miR-1539 MIMAT0007401 Homo sapiens miR-1539
uccugcgcgucccagaugccc

SEQ ID NO: 281 - RNA, 22 nt, Artificial sequence
  >hsa-miR-154-3p MIMAT0000453 Homo sapiens miR-154-3p
aaucauacacgguugaccuauu

SEQ ID NO: 282 - RNA, 22 nt, Artificial sequence
  >hsa-miR-154-5p MIMAT0000452 Homo sapiens miR-154-5p
uagguuauccguguugccuucg

SEQ ID NO: 283 - RNA, 22 nt, Artificial sequence
  >hsa-miR-155-3p MIMAT0004658 Homo sapiens miR-155-3p
cuccuacauauuagcauuaaca

SEQ ID NO: 284 - RNA, 23 nt, Artificial sequence
  >hsa-miR-155-5p MIMAT0000646 Homo sapiens miR-155-5p
uuaaugcuaaucgugauaggggu

SEQ ID NO: 285 - RNA, 20 nt, Artificial sequence
  >hsa-miR-1587 MIMAT0019077 Homo sapiens miR-1587
uugggcugggcuggguuggg

SEQ ID NO: 286 - RNA, 22 nt, Artificial sequence
  >hsa-miR-15a-3p MIMAT0004488 Homo sapiens miR-15a-3p
caggccauauugugcugccuca

SEQ ID NO: 287 - RNA, 22 nt, Artificial sequence
  >hsa-miR-15a-5p MIMAT0000068 Homo sapiens miR-15a-5p
uagcagcacauaaugguuugug

SEQ ID NO: 288 - RNA, 22 nt, Artificial sequence
  >hsa-miR-15b-3p MIMAT0004586 Homo sapiens miR-15b-3p
cgaaucauuauuugcugcucua

SEQ ID NO: 289 - RNA, 22 nt, Artificial sequence
  >hsa-miR-15b-5p MIMAT0000417 Homo sapiens miR-15b-5p
uagcagcacaucaugguuuaca

SEQ ID NO: 290 - RNA, 22 nt, Artificial sequence
  >hsa-miR-16-1-3p MIMAT0004489 Homo sapiens miR-16-1-3p
ccaguauuaacugugcugcuga

SEQ ID NO: 291 - RNA, 22 nt, Artificial sequence
  >hsa-miR-16-2-3p MIMAT0004518 Homo sapiens miR-16-2-3p
ccaauauuacugugcugcuuua

SEQ ID NO: 292 - RNA, 22 nt, Artificial sequence
  >hsa-miR-16-5p MIMAT0000069 Homo sapiens miR-16-5p
uagcagcacguaaauauuggcg

SEQ ID NO: 293 - RNA, 22 nt, Artificial sequence
  >hsa-miR-17-3p MIMAT0000071 Homo sapiens miR-17-3p
acugcagugaaggcacuuguag

SEQ ID NO: 294 - RNA, 23 nt, Artificial sequence
  >hsa-miR-17-5p MIMAT0000070 Homo sapiens miR-17-5p
caaagugcuuacagugcagguag

SEQ ID NO: 295 - RNA, 22 nt, Artificial sequence
  >hsa-miR-181a-2-3p MIMAT0004558 Homo sapiens miR-181a-2-3p
accacugaccguugacuguacc

SEQ ID NO: 296 - RNA, 22 nt, Artificial sequence
  >hsa-miR-181a-3p MIMAT0000270 Homo sapiens miR-181a-3p
accaucgaccguugauuguacc

SEQ ID NO: 297 - RNA, 23 nt, Artificial sequence
  >hsa-miR-181a-5p MIMAT0000256 Homo sapiens miR-181a-5p
aacauucaacgcugucggugagu

SEQ ID NO: 298 - RNA, 20 nt, Artificial sequence
  >hsa-miR-181b-2-3p MIMAT0031893 Homo sapiens miR-181b-2-3p
cucacugaucaaugaaugca

SEQ ID NO: 299 - RNA, 21 nt, Artificial sequence
  >hsa-miR-181b-3p MIMAT0022692 Homo sapiens miR-181b-3p
cucacugaacaaugaaugcaa

SEQ ID NO: 300 - RNA, 23 nt, Artificial sequence
  >hsa-miR-181b-5p MIMAT0000257 Homo sapiens miR-181b-5p
aacauucauugcugucggugggu

SEQ ID NO: 301 - RNA, 22 nt, Artificial sequence
  >hsa-miR-181c-3p MIMAT0004559 Homo sapiens miR-181c-3p
aaccaucgaccguugaguggac

SEQ ID NO: 302 - RNA, 22 nt, Artificial sequence
  >hsa-miR-181c-5p MIMAT0000258 Homo sapiens miR-181c-5p
aacauucaaccugucggugagu

SEQ ID NO: 303 - RNA, 21 nt, Artificial sequence
  >hsa-miR-181d-3p MIMAT0026608 Homo sapiens miR-181d-3p
ccaccgggggaugaaugucac

SEQ ID NO: 304 - RNA, 23 nt, Artificial sequence
  >hsa-miR-181d-5p MIMAT0002821 Homo sapiens miR-181d-5p
aacauucauuguugucggugggu

SEQ ID NO: 305 - RNA, 21 nt, Artificial sequence
  >hsa-miR-182-3p MIMAT0000260 Homo sapiens miR-182-3p
ugguucuagacuugccaacua

SEQ ID NO: 306 - RNA, 24 nt, Artificial sequence
  >hsa-miR-182-5p MIMAT0000259 Homo sapiens miR-182-5p
uuuggcaaugguagaacucacacu

SEQ ID NO: 307 - RNA, 18 nt, Artificial sequence
  >hsa-miR-1825 MIMAT0006765 Homo sapiens miR-1825
uccagugcccuccucucc

SEQ ID NO: 308 - RNA, 18 nt, Artificial sequence
  >hsa-miR-1827 MIMAT0006767 Homo sapiens miR-1827
ugaggcaguagauugaau

SEQ ID NO: 309 - RNA, 22 nt, Artificial sequence
  >hsa-miR-183-3p MIMAT0004560 Homo sapiens miR-183-3p
gugaauuaccgaagggccauaa

SEQ ID NO: 310 - RNA, 22 nt, Artificial sequence
  >hsa-miR-183-5p MIMAT0000261 Homo sapiens miR-183-5p
uauggcacugguagaauucacu

SEQ ID NO: 311 - RNA, 22 nt, Artificial sequence
  >hsa-miR-184 MIMAT0000454 Homo sapiens miR-184
uggacggagaacugauaagggu

SEQ ID NO: 312 - RNA, 22 nt, Artificial sequence
  >hsa-miR-185-3p MIMAT0004611 Homo sapiens miR-185-3p
aggggcuggcuuuccucugguc

SEQ ID NO: 313 - RNA, 22 nt, Artificial sequence
  >hsa-miR-185-5p MIMAT0000455 Homo sapiens miR-185-5p
uggagagaaaggcaguuccuga

SEQ ID NO: 314 - RNA, 22 nt, Artificial sequence
  >hsa-miR-186-3p MIMAT0004612 Homo sapiens miR-186-3p
gcccaaaggugaauuuuuuggg

SEQ ID NO: 315 - RNA, 22 nt, Artificial sequence
  >hsa-miR-186-5p MIMAT0000456 Homo sapiens miR-186-5p
caaagaauucuccuuuugggcu

SEQ ID NO: 316 - RNA, 22 nt, Artificial sequence
  >hsa-miR-187-3p MIMAT0000262 Homo sapiens miR-187-3p
ucgugucuuguguugcagccgg

SEQ ID NO: 317 - RNA, 22 nt, Artificial sequence
  >hsa-miR-187-5p MIMAT0004561 Homo sapiens miR-187-5p
ggcuacaacacaggacccgggc

SEQ ID NO: 318 - RNA, 21 nt, Artificial sequence
  >hsa-miR-188-3p MIMAT0004613 Homo sapiens miR-188-3p
cucccacaugcaggguuugca

SEQ ID NO: 319 - RNA, 21 nt, Artificial sequence
  >hsa-miR-188-5p MIMAT0000457 Homo sapiens miR-188-5p
caucccuugcaugguggaggg

SEQ ID NO: 320 - RNA, 23 nt, Artificial sequence
  >hsa-miR-18a-3p MIMAT0002891 Homo sapiens miR-18a-3p
acugcccuaagugcuccuucugg

SEQ ID NO: 321 - RNA, 23 nt, Artificial sequence
  >hsa-miR-18a-5p MIMAT0000072 Homo sapiens miR-18a-5p
uaaggugcaucuagugcagauag

SEQ ID NO: 322 - RNA, 22 nt, Artificial sequence
  >hsa-miR-18b-3p MIMAT0004751 Homo sapiens miR-18b-3p
ugcccuaaaugccccuucuggc

SEQ ID NO: 323 - RNA, 23 nt, Artificial sequence
  >hsa-miR-18b-5p MIMAT0001412 Homo sapiens miR-18b-5p
uaaggugcaucuagugcaguuag

SEQ ID NO: 324 - RNA, 21 nt, Artificial sequence
  >hsa-miR-1908-3p MIMAT0026916 Homo sapiens miR-1908-3p
ccggccgccggcuccgccccg

SEQ ID NO: 325 - RNA, 21 nt, Artificial sequence
  >hsa-miR-1908-5p MIMAT0007881 Homo sapiens miR-1908-5p
cggcggggacggcgauugguc

SEQ ID NO: 326 - RNA, 22 nt, Artificial sequence
  >hsa-miR-1909-3p MIMAT0007883 Homo sapiens miR-1909-3p
cgcaggggccgggugcucaccg

SEQ ID NO: 327 - RNA, 21 nt, Artificial sequence
  >hsa-miR-1909-5p MIMAT0007882 Homo sapiens miR-1909-5p
ugagugccggugccugcccug

SEQ ID NO: 328 - RNA, 21 nt, Artificial sequence
  >hsa-miR-190a-3p MIMAT0026482 Homo sapiens miR-190a-3p
cuauauaucaaacauauuccu

SEQ ID NO: 329 - RNA, 22 nt, Artificial sequence
  >hsa-miR-190a-5p MIMAT0000458 Homo sapiens miR-190a-5p
ugauauguuugauauauuaggu

SEQ ID NO: 330 - RNA, 21 nt, Artificial sequence
  >hsa-miR-190b MIMAT0004929 Homo sapiens miR-190b
ugauauguuugauauuggguu

SEQ ID NO: 331 - RNA, 22 nt, Artificial sequence
  >hsa-miR-191-3p MIMAT0001618 Homo sapiens miR-191-3p
gcugcgcuuggauuucgucccc

SEQ ID NO: 332 - RNA, 23 nt, Artificial sequence
  >hsa-miR-191-5p MIMAT0000440 Homo sapiens miR-191-5p
caacggaaucccaaaagcagcug

SEQ ID NO: 333 - RNA, 20 nt, Artificial sequence
  >hsa-miR-1910-3p MIMAT0026917 Homo sapiens miR-1910-3p
gaggcagaagcaggaugaca

SEQ ID NO: 334 - RNA, 21 nt, Artificial sequence
  >hsa-miR-1910-5p MIMAT0007884 Homo sapiens miR-1910-5p
ccaguccugugccugccgccu

SEQ ID NO: 335 - RNA, 20 nt, Artificial sequence
  >hsa-miR-1911-3p MIMAT0007886 Homo sapiens miR-1911-3p
caccaggcauuguggucucc

SEQ ID NO: 336 - RNA, 23 nt, Artificial sequence
  >hsa-miR-1911-5p MIMAT0007885 Homo sapiens miR-1911-5p
ugaguaccgccaugucuguuggg

SEQ ID NO: 337 - RNA, 22 nt, Artificial sequence
  >hsa-miR-1912 MIMAT0007887 Homo sapiens miR-1912
uacccagagcaugcagugugaa

SEQ ID NO: 338 - RNA, 22 nt, Artificial sequence
  >hsa-miR-1913 MIMAT0007888 Homo sapiens miR-1913
ucugcccccuccgcugcugcca

SEQ ID NO: 339 - RNA, 22 nt, Artificial sequence
  >hsa-miR-1914-3p MIMAT0007890 Homo sapiens miR-1914-3p
ggaggggucccgcacugggagg

SEQ ID NO: 340 - RNA, 22 nt, Artificial sequence
  >hsa-miR-1914-5p MIMAT0007889 Homo sapiens miR-1914-5p
cccugugcccggcccacuucug

SEQ ID NO: 341 - RNA, 20 nt, Artificial sequence
  >hsa-miR-1915-3p MIMAT0007892 Homo sapiens miR-1915-3p
ccccagggcgacgcggcggg

SEQ ID NO: 342 - RNA, 22 nt, Artificial sequence
  >hsa-miR-1915-5p MIMAT0007891 Homo sapiens miR-1915-5p
accuugccuugcugcccgggcc

SEQ ID NO: 343 - RNA, 22 nt, Artificial sequence
  >hsa-miR-192-3p MIMAT0004543 Homo sapiens miR-192-3p
cugccaauuccauaggucacag

SEQ ID NO: 344 - RNA, 21 nt, Artificial sequence
  >hsa-miR-192-5p MIMAT0000222 Homo sapiens miR-192-5p
cugaccuaugaauugacagcc

SEQ ID NO: 345 - RNA, 22 nt, Artificial sequence
  >hsa-miR-193a-3p MIMAT0000459 Homo sapiens miR-193a-3p
aacuggccuacaaagucccagu

SEQ ID NO: 346 - RNA, 22 nt, Artificial sequence
  >hsa-miR-193a-5p MIMAT0004614 Homo sapiens miR-193a-5p
ugggucuuugcgggcgagauga

SEQ ID NO: 347 - RNA, 22 nt, Artificial sequence
  >hsa-miR-193b-3p MIMAT0002819 Homo sapiens miR-193b-3p
aacuggcccucaaagucccgcu

SEQ ID NO: 348 - RNA, 22 nt, Artificial sequence
  >hsa-miR-193b-5p MIMAT0004767 Homo sapiens miR-193b-5p
cgggguuuugagggcgagauga

SEQ ID NO: 349 - RNA, 22 nt, Artificial sequence
  >hsa-miR-194-3p MIMAT0004671 Homo sapiens miR-194-3p
ccaguggggcugcuguuaucug

SEQ ID NO: 350 - RNA, 22 nt, Artificial sequence
  >hsa-miR-194-5p MIMAT0000460 Homo sapiens miR-194-5p
uguaacagcaacuccaugugga

SEQ ID NO: 351 - RNA, 22 nt, Artificial sequence
  >hsa-miR-195-3p MIMAT0004615 Homo sapiens miR-195-3p
ccaauauuggcugugcugcucc

SEQ ID NO: 352 - RNA, 21 nt, Artificial sequence
  >hsa-miR-195-5p MIMAT0000461 Homo sapiens miR-195-5p
uagcagcacagaaauauuggc

SEQ ID NO: 353 - RNA, 22 nt, Artificial sequence
  >hsa-miR-196a-3p MIMAT0004562 Homo sapiens miR-196a-3p
cggcaacaagaaacugccugag

SEQ ID NO: 354 - RNA, 22 nt, Artificial sequence
  >hsa-miR-196a-5p MIMAT0000226 Homo sapiens miR-196a-5p
uagguaguuucauguuguuggg

SEQ ID NO: 355 - RNA, 22 nt, Artificial sequence
  >hsa-miR-196b-3p MIMAT0009201 Homo sapiens miR-196b-3p
ucgacagcacgacacugccuuc

SEQ ID NO: 356 - RNA, 22 nt, Artificial sequence
  >hsa-miR-196b-5p MIMAT0001080 Homo sapiens miR-196b-5p
uagguaguuuccuguuguuggg

SEQ ID NO: 357 - RNA, 22 nt, Artificial sequence
  >hsa-miR-197-3p MIMAT0000227 Homo sapiens miR-197-3p
uucaccaccuucuccacccagc

SEQ ID NO: 358 - RNA, 23 nt, Artificial sequence
  >hsa-miR-197-5p MIMAT0022691 Homo sapiens miR-197-5p
cggguagagagggcagugggagg

SEQ ID NO: 359 - RNA, 22 nt, Artificial sequence
  >hsa-miR-1972 MIMAT0009447 Homo sapiens miR-1972
ucaggccaggcacaguggcuca

SEQ ID NO: 360 - RNA, 19 nt, Artificial sequence
  >hsa-miR-1973 MIMAT0009448 Homo sapiens miR-1973
accgugcaaagguagcaua

SEQ ID NO: 361 - RNA, 20 nt, Artificial sequence
  >hsa-miR-1976 MIMAT0009451 Homo sapiens miR-1976
ccuccugcccuccuugcugu

SEQ ID NO: 362 - RNA, 22 nt, Artificial sequence
  >hsa-miR-198 MIMAT0000228 Homo sapiens miR-198
gguccagaggggagauagguuc

SEQ ID NO: 363 - RNA, 22 nt, Artificial sequence
  >hsa-miR-199a-3p MIMAT0000232 Homo sapiens miR-199a-3p
acaguagucugcacauugguua

SEQ ID NO: 364 - RNA, 23 nt, Artificial sequence
  >hsa-miR-199a-5p MIMAT0000231 Homo sapiens miR-199a-5p
cccaguguucagacuaccuguuc

SEQ ID NO: 365 - RNA, 22 nt, Artificial sequence
  >hsa-miR-199b-3p MIMAT0004563 Homo sapiens miR-199b-3p
acaguagucugcacauugguua

SEQ ID NO: 366 - RNA, 23 nt, Artificial sequence
  >hsa-miR-199b-5p MIMAT0000263 Homo sapiens miR-199b-5p
cccaguguuuagacuaucuguuc

SEQ ID NO: 367 - RNA, 23 nt, Artificial sequence
  >hsa-miR-19a-3p MIMAT0000073 Homo sapiens miR-19a-3p
ugugcaaaucuaugcaaaacuga

SEQ ID NO: 368 - RNA, 22 nt, Artificial sequence
  >hsa-miR-19a-5p MIMAT0004490 Homo sapiens miR-19a-5p
aguuuugcauaguugcacuaca

SEQ ID NO: 369 - RNA, 23 nt, Artificial sequence
  >hsa-miR-19b-1-5p MIMAT0004491 Homo sapiens miR-19b-1-5p
aguuuugcagguuugcauccagc

SEQ ID NO: 370 - RNA, 22 nt, Artificial sequence
  >hsa-miR-19b-2-5p MIMAT0004492 Homo sapiens miR-19b-2-5p
aguuuugcagguuugcauuuca

SEQ ID NO: 371 - RNA, 23 nt, Artificial sequence
  >hsa-miR-19b-3p MIMAT0000074 Homo sapiens miR-19b-3p
ugugcaaauccaugcaaaacuga

SEQ ID NO: 372 - RNA, 22 nt, Artificial sequence
  >hsa-miR-200a-3p MIMAT0000682 Homo sapiens miR-200a-3p
uaacacugucugguaacgaugu

SEQ ID NO: 373 - RNA, 22 nt, Artificial sequence
  >hsa-miR-200a-5p MIMAT0001620 Homo sapiens miR-200a-5p
caucuuaccggacagugcugga

SEQ ID NO: 374 - RNA, 22 nt, Artificial sequence
  >hsa-miR-200b-3p MIMAT0000318 Homo sapiens miR-200b-3p
uaauacugccugguaaugauga

SEQ ID NO: 375 - RNA, 22 nt, Artificial sequence
  >hsa-miR-200b-5p MIMAT0004571 Homo sapiens miR-200b-5p
caucuuacugggcagcauugga

SEQ ID NO: 376 - RNA, 23 nt, Artificial sequence
  >hsa-miR-200c-3p MIMAT0000617 Homo sapiens miR-200c-3p
uaauacugccggguaaugaugga

SEQ ID NO: 377 - RNA, 22 nt, Artificial sequence
  >hsa-miR-200c-5p MIMAT0004657 Homo sapiens miR-200c-5p
cgucuuacccagcaguguuugg

SEQ ID NO: 378 - RNA, 20 nt, Artificial sequence
  >hsa-miR-202-3p MIMAT0002811 Homo sapiens miR-202-3p
agagguauagggcaugggaa

SEQ ID NO: 379 - RNA, 22 nt, Artificial sequence
  >hsa-miR-202-5p MIMAT0002810 Homo sapiens miR-202-5p
uuccuaugcauauacuucuuug

SEQ ID NO: 380 - RNA, 22 nt, Artificial sequence
  >hsa-miR-203a-3p MIMAT0000264 Homo sapiens miR-203a-3p
gugaaauguuuaggaccacuag

SEQ ID NO: 381 - RNA, 25 nt, Artificial sequence
  >hsa-miR-203a-5p MIMAT0031890 Homo sapiens miR-203a-5p
agugguucuuaacaguucaacaguu

SEQ ID NO: 382 - RNA, 23 nt, Artificial sequence
  >hsa-miR-203b-3p MIMAT0019814 Homo sapiens miR-203b-3p
uugaacuguuaagaaccacugga

SEQ ID NO: 383 - RNA, 22 nt, Artificial sequence
  >hsa-miR-203b-5p MIMAT0019813 Homo sapiens miR-203b-5p
uagugguccuaaacauuucaca

SEQ ID NO: 384 - RNA, 21 nt, Artificial sequence
  >hsa-miR-204-3p MIMAT0022693 Homo sapiens miR-204-3p
gcugggaaggcaaagggacgu

SEQ ID NO: 385 - RNA, 22 nt, Artificial sequence
  >hsa-miR-204-5p MIMAT0000265 Homo sapiens miR-204-5p
uucccuuugucauccuaugccu

SEQ ID NO: 386 - RNA, 21 nt, Artificial sequence
  >hsa-miR-205-3p MIMAT0009197 Homo sapiens miR-205-3p
gauuucaguggagugaaguuc

SEQ ID NO: 387 - RNA, 22 nt, Artificial sequence
  >hsa-miR-205-5p MIMAT0000266 Homo sapiens miR-205-5p
uccuucauuccaccggagucug

SEQ ID NO: 388 - RNA, 20 nt, Artificial sequence
  >hsa-miR-2052 MIMAT0009977 Homo sapiens miR-2052
uguuuugauaacaguaaugu

SEQ ID NO: 389 - RNA, 23 nt, Artificial sequence
  >hsa-miR-2053 MIMAT0009978 Homo sapiens miR-2053
guguuaauuaaaccucuauuuac

SEQ ID NO: 390 - RNA, 23 nt, Artificial sequence
  >hsa-miR-2054 MIMAT0009979 Homo sapiens miR-2054
cuguaauauaaauuuaauuuauu

SEQ ID NO: 391 - RNA, 22 nt, Artificial sequence
  >hsa-miR-206 MIMAT0000462 Homo sapiens miR-206
uggaauguaaggaagugugugg

SEQ ID NO: 392 - RNA, 22 nt, Artificial sequence
  >hsa-miR-208a-3p MIMAT0000241 Homo sapiens miR-208a-3p
auaagacgagcaaaaagcuugu

SEQ ID NO: 393 - RNA, 22 nt, Artificial sequence
  >hsa-miR-208a-5p MIMAT0026474 Homo sapiens miR-208a-5p
gagcuuuuggcccggguuauac

SEQ ID NO: 394 - RNA, 22 nt, Artificial sequence
  >hsa-miR-208b-3p MIMAT0004960 Homo sapiens miR-208b-3p
auaagacgaacaaaagguuugu

SEQ ID NO: 395 - RNA, 22 nt, Artificial sequence
  >hsa-miR-208b-5p MIMAT0026722 Homo sapiens miR-208b-5p
aagcuuuuugcucgaauuaugu

SEQ ID NO: 396 - RNA, 22 nt, Artificial sequence
  >hsa-miR-20a-3p MIMAT0004493 Homo sapiens miR-20a-3p
acugcauuaugagcacuuaaag

SEQ ID NO: 397 - RNA, 23 nt, Artificial sequence
  >hsa-miR-20a-5p MIMAT0000075 Homo sapiens miR-20a-5p
uaaagugcuuauagugcagguag

SEQ ID NO: 398 - RNA, 22 nt, Artificial sequence
  >hsa-miR-20b-3p MIMAT0004752 Homo sapiens miR-20b-3p
acuguaguaugggcacuuccag

SEQ ID NO: 399 - RNA, 23 nt, Artificial sequence
  >hsa-miR-20b-5p MIMAT0001413 Homo sapiens miR-20b-5p
caaagugcucauagugcagguag

SEQ ID NO: 400 - RNA, 21 nt, Artificial sequence
  >hsa-miR-21-3p MIMAT0004494 Homo sapiens miR-21-3p
caacaccagucgaugggcugu

SEQ ID NO: 401 - RNA, 22 nt, Artificial sequence
  >hsa-miR-21-5p MIMAT0000076 Homo sapiens miR-21-5p
uagcuuaucagacugauguuga

SEQ ID NO: 402 - RNA, 22 nt, Artificial sequence
  >hsa-miR-210-3p MIMAT0000267 Homo sapiens miR-210-3p
cugugcgugugacagcggcuga

SEQ ID NO: 403 - RNA, 22 nt, Artificial sequence
  >hsa-miR-210-5p MIMAT0026475 Homo sapiens miR-210-5p
agccccugcccaccgcacacug

SEQ ID NO: 404 - RNA, 21 nt, Artificial sequence
  >hsa-miR-211-3p MIMAT0022694 Homo sapiens miR-211-3p
gcagggacagcaaaggggugc

SEQ ID NO: 405 - RNA, 22 nt, Artificial sequence
  >hsa-miR-211-5p MIMAT0000268 Homo sapiens miR-211-5p
uucccuuugucauccuucgccu

SEQ ID NO: 406 - RNA, 22 nt, Artificial sequence
  >hsa-miR-2110 MIMAT0010133 Homo sapiens miR-2110
uuggggaaacggccgcugagug

SEQ ID NO: 407 - RNA, 21 nt, Artificial sequence
  >hsa-miR-2113 MIMAT0009206 Homo sapiens miR-2113
auuugugcuuggcucugucac

SEQ ID NO: 408 - RNA, 21 nt, Artificial sequence
  >hsa-miR-2114-3p MIMAT0011157 Homo sapiens miR-2114-3p
cgagccucaagcaagggacuu

SEQ ID NO: 409 - RNA, 22 nt, Artificial sequence
  >hsa-miR-2114-5p MIMAT0011156 Homo sapiens miR-2114-5p
uagucccuuccuugaagcgguc

SEQ ID NO: 410 - RNA, 22 nt, Artificial sequence
  >hsa-miR-2115-3p MIMAT0011159 Homo sapiens miR-2115-3p
caucagaauucauggaggcuag

SEQ ID NO: 411 - RNA, 22 nt, Artificial sequence
  >hsa-miR-2115-5p MIMAT0011158 Homo sapiens miR-2115-5p
agcuuccaugacuccugaugga

SEQ ID NO: 412 - RNA, 21 nt, Artificial sequence
  >hsa-miR-2116-3p MIMAT0011161 Homo sapiens miR-2116-3p
ccucccaugccaagaacuccc

SEQ ID NO: 413 - RNA, 21 nt, Artificial sequence
  >hsa-miR-2116-5p MIMAT0011160 Homo sapiens miR-2116-5p
gguucuuagcauaggaggucu

SEQ ID NO: 414 - RNA, 21 nt, Artificial sequence
  >hsa-miR-2117 MIMAT0011162 Homo sapiens miR-2117
uguucucuuugccaaggacag

SEQ ID NO: 415 - RNA, 21 nt, Artificial sequence
  >hsa-miR-212-3p MIMAT0000269 Homo sapiens miR-212-3p
uaacagucuccagucacggcc

SEQ ID NO: 416 - RNA, 23 nt, Artificial sequence
  >hsa-miR-212-5p MIMAT0022695 Homo sapiens miR-212-5p
accuuggcucuagacugcuuacu

SEQ ID NO: 417 - RNA, 22 nt, Artificial sequence
  >hsa-miR-214-3p MIMAT0000271 Homo sapiens miR-214-3p
acagcaggcacagacaggcagu

SEQ ID NO: 418 - RNA, 22 nt, Artificial sequence
  >hsa-miR-214-5p MIMAT0004564 Homo sapiens miR-214-5p
ugccugucuacacuugcugugc

SEQ ID NO: 419 - RNA, 23 nt, Artificial sequence
  >hsa-miR-215-3p MIMAT0026476 Homo sapiens miR-215-3p
ucugucauuucuuuaggccaaua

SEQ ID NO: 420 - RNA, 21 nt, Artificial sequence
  >hsa-miR-215-5p MIMAT0000272 Homo sapiens miR-215-5p
augaccuaugaauugacagac

SEQ ID NO: 421 - RNA, 22 nt, Artificial sequence
  >hsa-miR-216a-3p MIMAT0022844 Homo sapiens miR-216a-3p
ucacaguggucucugggauuau

SEQ ID NO: 422 - RNA, 22 nt, Artificial sequence
  >hsa-miR-216a-5p MIMAT0000273 Homo sapiens miR-216a-5p
uaaucucagcuggcaacuguga

SEQ ID NO: 423 - RNA, 24 nt, Artificial sequence
  >hsa-miR-216b-3p MIMAT0026721 Homo sapiens miR-216b-3p
acacacuuacccguagagauucua

SEQ ID NO: 424 - RNA, 22 nt, Artificial sequence
  >hsa-miR-216b-5p MIMAT0004959 Homo sapiens miR-216b-5p
aaaucucugcaggcaaauguga

SEQ ID NO: 425 - RNA, 23 nt, Artificial sequence
  >hsa-miR-217 MIMAT0000274 Homo sapiens miR-217
uacugcaucaggaacugauugga

SEQ ID NO: 426 - RNA, 22 nt, Artificial sequence
  >hsa-miR-218-1-3p MIMAT0004565 Homo sapiens miR-218-1-3p
augguuccgucaagcaccaugg

SEQ ID NO: 427 - RNA, 22 nt, Artificial sequence
  >hsa-miR-218-2-3p MIMAT0004566 Homo sapiens miR-218-2-3p
caugguucugucaagcaccgcg

SEQ ID NO: 428 - RNA, 21 nt, Artificial sequence
  >hsa-miR-218-5p MIMAT0000275 Homo sapiens miR-218-5p
uugugcuugaucuaaccaugu

SEQ ID NO: 429 - RNA, 22 nt, Artificial sequence
  >hsa-miR-219a-1-3p MIMAT0004567 Homo sapiens miR-219a-1-3p
agaguugagucuggacgucccg

SEQ ID NO: 430 - RNA, 22 nt, Artificial sequence
  >hsa-miR-219a-2-3p MIMAT0004675 Homo sapiens miR-219a-2-3p
agaauuguggcuggacaucugu

SEQ ID NO: 431 - RNA, 21 nt, Artificial sequence
  >hsa-miR-219a-5p MIMAT0000276 Homo sapiens miR-219a-5p
ugauuguccaaacgcaauucu

SEQ ID NO: 432 - RNA, 23 nt, Artificial sequence
  >hsa-miR-219b-3p MIMAT0019748 Homo sapiens miR-219b-3p
agaauugcguuuggacaaucagu

SEQ ID NO: 433 - RNA, 22 nt, Artificial sequence
  >hsa-miR-219b-5p MIMAT0019747 Homo sapiens miR-219b-5p
agauguccagccacaauucucg

SEQ ID NO: 434 - RNA, 22 nt, Artificial sequence
  >hsa-miR-22-3p MIMAT0000077 Homo sapiens miR-22-3p
aagcugccaguugaagaacugu

SEQ ID NO: 435 - RNA, 22 nt, Artificial sequence
  >hsa-miR-22-5p MIMAT0004495 Homo sapiens miR-22-5p
aguucuucaguggcaagcuuua

SEQ ID NO: 436 - RNA, 23 nt, Artificial sequence
  >hsa-miR-221-3p MIMAT0000278 Homo sapiens miR-221-3p
agcuacauugucugcuggguuuc

SEQ ID NO: 437 - RNA, 22 nt, Artificial sequence
  >hsa-miR-221-5p MIMAT0004568 Homo sapiens miR-221-5p
accuggcauacaauguagauuu

SEQ ID NO: 438 - RNA, 21 nt, Artificial sequence
  >hsa-miR-222-3p MIMAT0000279 Homo sapiens miR-222-3p
agcuacaucuggcuacugggu

SEQ ID NO: 439 - RNA, 22 nt, Artificial sequence
  >hsa-miR-222-5p MIMAT0004569 Homo sapiens miR-222-5p
cucaguagccaguguagauccu

SEQ ID NO: 440 - RNA, 22 nt, Artificial sequence
  >hsa-miR-223-3p MIMAT0000280 Homo sapiens miR-223-3p
ugucaguuugucaaauacccca

SEQ ID NO: 441 - RNA, 22 nt, Artificial sequence
  >hsa-miR-223-5p MIMAT0004570 Homo sapiens miR-223-5p
cguguauuugacaagcugaguu

SEQ ID NO: 442 - RNA, 23 nt, Artificial sequence
  >hsa-miR-224-3p MIMAT0009198 Homo sapiens miR-224-3p
aaaauggugcccuagugacuaca

SEQ ID NO: 443 - RNA, 21 nt, Artificial sequence
  >hsa-miR-224-5p MIMAT0000281 Homo sapiens miR-224-5p
caagucacuagugguuccguu

SEQ ID NO: 444 - RNA, 22 nt, Artificial sequence
  >hsa-miR-2276-3p MIMAT0011775 Homo sapiens miR-2276-3p
ucugcaagugucagaggcgagg

SEQ ID NO: 445 - RNA, 22 nt, Artificial sequence
  >hsa-miR-2276-5p MIMAT0026921 Homo sapiens miR-2276-5p
gcccucugucaccuugcagacg

SEQ ID NO: 446 - RNA, 21 nt, Artificial sequence
  >hsa-miR-2277-3p MIMAT0011777 Homo sapiens miR-2277-3p
ugacagcgcccugccuggcuc

SEQ ID NO: 447 - RNA, 24 nt, Artificial sequence
  >hsa-miR-2277-5p MIMAT0017352 Homo sapiens miR-2277-5p
agcgcgggcugagcgcugccaguc

SEQ ID NO: 448 - RNA, 22 nt, Artificial sequence
  >hsa-miR-2278 MIMAT0011778 Homo sapiens miR-2278
gagagcaguguguguugccugg

SEQ ID NO: 449 - RNA, 22 nt, Artificial sequence
  >hsa-miR-2355-3p MIMAT0017950 Homo sapiens miR-2355-3p
auuguccuugcuguuuggagau

SEQ ID NO: 450 - RNA, 21 nt, Artificial sequence
  >hsa-miR-2355-5p MIMAT0016895 Homo sapiens miR-2355-5p
auccccagauacaauggacaa

SEQ ID NO: 451 - RNA, 20 nt, Artificial sequence
  >hsa-miR-2392 MIMAT0019043 Homo sapiens miR-2392
uaggaugggggugagaggug

SEQ ID NO: 452 - RNA, 21 nt, Artificial sequence
  >hsa-miR-23a-3p MIMAT0000078 Homo sapiens miR-23a-3p
aucacauugccagggauuucc

SEQ ID NO: 453 - RNA, 22 nt, Artificial sequence
  >hsa-miR-23a-5p MIMAT0004496 Homo sapiens miR-23a-5p
gggguuccuggggaugggauuu

SEQ ID NO: 454 - RNA, 21 nt, Artificial sequence
  >hsa-miR-23b-3p MIMAT0000418 Homo sapiens miR-23b-3p
aucacauugccagggauuacc

SEQ ID NO: 455 - RNA, 22 nt, Artificial sequence
  >hsa-miR-23b-5p MIMAT0004587 Homo sapiens miR-23b-5p
uggguuccuggcaugcugauuu

SEQ ID NO: 456 - RNA, 22 nt, Artificial sequence
  >hsa-miR-23c MIMAT0018000 Homo sapiens miR-23c
aucacauugccagugauuaccc

SEQ ID NO: 457 - RNA, 22 nt, Artificial sequence
  >hsa-miR-24-1-5p MIMAT0000079 Homo sapiens miR-24-1-5p
ugccuacugagcugauaucagu

SEQ ID NO: 458 - RNA, 22 nt, Artificial sequence
  >hsa-miR-24-2-5p MIMAT0004497 Homo sapiens miR-24-2-5p
ugccuacugagcugaaacacag

SEQ ID NO: 459 - RNA, 22 nt, Artificial sequence
  >hsa-miR-24-3p MIMAT0000080 Homo sapiens miR-24-3p
uggcucaguucagcaggaacag

SEQ ID NO: 460 - RNA, 22 nt, Artificial sequence
  >hsa-miR-2467-3p MIMAT0019953 Homo sapiens miR-2467-3p
agcagaggcagagaggcucagg

SEQ ID NO: 461 - RNA, 23 nt, Artificial sequence
  >hsa-miR-2467-5p MIMAT0019952 Homo sapiens miR-2467-5p
ugaggcucuguuagccuuggcuc

SEQ ID NO: 462 - RNA, 22 nt, Artificial sequence
  >hsa-miR-25-3p MIMAT0000081 Homo sapiens miR-25-3p
cauugcacuugucucggucuga

SEQ ID NO: 463 - RNA, 21 nt, Artificial sequence
  >hsa-miR-25-5p MIMAT0004498 Homo sapiens miR-25-5p
aggcggagacuugggcaauug

SEQ ID NO: 464 - RNA, 22 nt, Artificial sequence
  >hsa-miR-2681-3p MIMAT0013516 Homo sapiens miR-2681-3p
uaucauggaguugguaaagcac

SEQ ID NO: 465 - RNA, 22 nt, Artificial sequence
  >hsa-miR-2681-5p MIMAT0013515 Homo sapiens miR-2681-5p
guuuuaccaccuccaggagacu

SEQ ID NO: 466 - RNA, 22 nt, Artificial sequence
  >hsa-miR-2682-3p MIMAT0013518 Homo sapiens miR-2682-3p
cgccucuucagcgcugucuucc

SEQ ID NO: 467 - RNA, 23 nt, Artificial sequence
  >hsa-miR-2682-5p MIMAT0013517 Homo sapiens miR-2682-5p
caggcagugacuguucagacguc

SEQ ID NO: 468 - RNA, 22 nt, Artificial sequence
  >hsa-miR-26a-1-3p MIMAT0004499 Homo sapiens miR-26a-1-3p
ccuauucuugguuacuugcacg

SEQ ID NO: 469 - RNA, 22 nt, Artificial sequence
  >hsa-miR-26a-2-3p MIMAT0004681 Homo sapiens miR-26a-2-3p
ccuauucuugauuacuuguuuc

SEQ ID NO: 470 - RNA, 22 nt, Artificial sequence
  >hsa-miR-26a-5p MIMAT0000082 Homo sapiens miR-26a-5p
uucaaguaauccaggauaggcu

SEQ ID NO: 471 - RNA, 22 nt, Artificial sequence
  >hsa-miR-26b-3p MIMAT0004500 Homo sapiens miR-26b-3p
ccuguucuccauuacuuggcuc

SEQ ID NO: 472 - RNA, 21 nt, Artificial sequence
  >hsa-miR-26b-5p MIMAT0000083 Homo sapiens miR-26b-5p
uucaaguaauucaggauaggu

SEQ ID NO: 473 - RNA, 21 nt, Artificial sequence
  >hsa-miR-27a-3p MIMAT0000084 Homo sapiens miR-27a-3p
uucacaguggcuaaguuccgc

SEQ ID NO: 474 - RNA, 22 nt, Artificial sequence
  >hsa-miR-27a-5p MIMAT0004501 Homo sapiens miR-27a-5p
agggcuuagcugcuugugagca

SEQ ID NO: 475 - RNA, 21 nt, Artificial sequence
  >hsa-miR-27b-3p MIMAT0000419 Homo sapiens miR-27b-3p
uucacaguggcuaaguucugc

SEQ ID NO: 476 - RNA, 22 nt, Artificial sequence
  >hsa-miR-27b-5p MIMAT0004588 Homo sapiens miR-27b-5p
agagcuuagcugauuggugaac

SEQ ID NO: 477 - RNA, 22 nt, Artificial sequence
  >hsa-miR-28-3p MIMAT0004502 Homo sapiens miR-28-3p
cacuagauugugagcuccugga

SEQ ID NO: 478 - RNA, 22 nt, Artificial sequence
  >hsa-miR-28-5p MIMAT0000085 Homo sapiens miR-28-5p
aaggagcucacagucuauugag

SEQ ID NO: 479 - RNA, 19 nt, Artificial sequence
  >hsa-miR-2861 MIMAT0013802 Homo sapiens miR-2861
ggggccuggcggugggcgg

SEQ ID NO: 480 - RNA, 21 nt, Artificial sequence
  >hsa-miR-2909 MIMAT0013863 Homo sapiens miR-2909
guuagggccaacaucucuugg

SEQ ID NO: 481 - RNA, 22 nt, Artificial sequence
  >hsa-miR-296-3p MIMAT0004679 Homo sapiens miR-296-3p
gaggguuggguggaggcucucc

SEQ ID NO: 482 - RNA, 21 nt, Artificial sequence
  >hsa-miR-296-5p MIMAT0000690 Homo sapiens miR-296-5p
agggcccccccucaauccugu

SEQ ID NO: 483 - RNA, 21 nt, Artificial sequence
  >hsa-miR-297 MIMAT0004450 Homo sapiens miR-297
auguaugugugcaugugcaug

SEQ ID NO: 484 - RNA, 24 nt, Artificial sequence
  >hsa-miR-298 MIMAT0004901 Homo sapiens miR-298
agcagaagcagggagguucuccca

SEQ ID NO: 485 - RNA, 22 nt, Artificial sequence
  >hsa-miR-299-3p MIMAT0000687 Homo sapiens miR-299-3p
uaugugggaugguaaaccgcuu

SEQ ID NO: 486 - RNA, 22 nt, Artificial sequence
  >hsa-miR-299-5p MIMAT0002890 Homo sapiens miR-299-5p
ugguuuaccgucccacauacau

SEQ ID NO: 487 - RNA, 22 nt, Artificial sequence
  >hsa-miR-29a-3p MIMAT0000086 Homo sapiens miR-29a-3p
uagcaccaucugaaaucgguua

SEQ ID NO: 488 - RNA, 22 nt, Artificial sequence
  >hsa-miR-29a-5p MIMAT0004503 Homo sapiens miR-29a-5p
acugauuucuuuugguguucag

SEQ ID NO: 489 - RNA, 24 nt, Artificial sequence
  >hsa-miR-29b-1-5p MIMAT0004514 Homo sapiens miR-29b-1-5p
gcugguuucauauggugguuuaga

SEQ ID NO: 490 - RNA, 22 nt, Artificial sequence
  >hsa-miR-29b-2-5p MIMAT0004515 Homo sapiens miR-29b-2-5p
cugguuucacaugguggcuuag

SEQ ID NO: 491 - RNA, 23 nt, Artificial sequence
  >hsa-miR-29b-3p MIMAT0000100 Homo sapiens miR-29b-3p
uagcaccauuugaaaucaguguu

SEQ ID NO: 492 - RNA, 22 nt, Artificial sequence
  >hsa-miR-29c-3p MIMAT0000681 Homo sapiens miR-29c-3p
uagcaccauuugaaaucgguua

SEQ ID NO: 493 - RNA, 22 nt, Artificial sequence
  >hsa-miR-29c-5p MIMAT0004673 Homo sapiens miR-29c-5p
ugaccgauuucuccugguguuc

SEQ ID NO: 494 - RNA, 22 nt, Artificial sequence
  >hsa-miR-300 MIMAT0004903 Homo sapiens miR-300
uauacaagggcagacucucucu

SEQ ID NO: 495 - RNA, 23 nt, Artificial sequence
  >hsa-miR-301a-3p MIMAT0000688 Homo sapiens miR-301a-3p
cagugcaauaguauugucaaagc

SEQ ID NO: 496 - RNA, 22 nt, Artificial sequence
  >hsa-miR-301a-5p MIMAT0022696 Homo sapiens miR-301a-5p
gcucugacuuuauugcacuacu

SEQ ID NO: 497 - RNA, 23 nt, Artificial sequence
  >hsa-miR-301b-3p MIMAT0004958 Homo sapiens miR-301b-3p
cagugcaaugauauugucaaagc

SEQ ID NO: 498 - RNA, 22 nt, Artificial sequence
  >hsa-miR-301b-5p MIMAT0032026 Homo sapiens miR-301b-5p
gcucugacgagguugcacuacu

SEQ ID NO: 499 - RNA, 23 nt, Artificial sequence
  >hsa-miR-302a-3p MIMAT0000684 Homo sapiens miR-302a-3p
uaagugcuuccauguuuugguga

SEQ ID NO: 500 - RNA, 23 nt, Artificial sequence
  >hsa-miR-302a-5p MIMAT0000683 Homo sapiens miR-302a-5p
acuuaaacguggauguacuugcu

SEQ ID NO: 501 - RNA, 23 nt, Artificial sequence
  >hsa-miR-302b-3p MIMAT0000715 Homo sapiens miR-302b-3p
uaagugcuuccauguuuuaguag

SEQ ID NO: 502 - RNA, 22 nt, Artificial sequence
  >hsa-miR-302b-5p MIMAT0000714 Homo sapiens miR-302b-5p
acuuuaacauggaagugcuuuc

SEQ ID NO: 503 - RNA, 23 nt, Artificial sequence
  >hsa-miR-302c-3p MIMAT0000717 Homo sapiens miR-302c-3p
uaagugcuuccauguuucagugg

SEQ ID NO: 504 - RNA, 22 nt, Artificial sequence
  >hsa-miR-302c-5p MIMAT0000716 Homo sapiens miR-302c-5p
uuuaacauggggguaccugcug

SEQ ID NO: 505 - RNA, 23 nt, Artificial sequence
  >hsa-miR-302d-3p MIMAT0000718 Homo sapiens miR-302d-3p
uaagugcuuccauguuugagugu

SEQ ID NO: 506 - RNA, 22 nt, Artificial sequence
  >hsa-miR-302d-5p MIMAT0004685 Homo sapiens miR-302d-5p
acuuuaacauggaggcacuugc

SEQ ID NO: 507 - RNA, 17 nt, Artificial sequence
  >hsa-miR-302e MIMAT0005931 Homo sapiens miR-302e
uaagugcuuccaugcuu

SEQ ID NO: 508 - RNA, 17 nt, Artificial sequence
  >hsa-miR-302f MIMAT0005932 Homo sapiens miR-302f
uaauugcuuccauguuu

SEQ ID NO: 509 - RNA, 23 nt, Artificial sequence
  >hsa-miR-3064-3p MIMAT0019865 Homo sapiens miR-3064-3p
uugccacacugcaacaccuuaca

SEQ ID NO: 510 - RNA, 21 nt, Artificial sequence
  >hsa-miR-3064-5p MIMAT0019864 Homo sapiens miR-3064-5p
ucuggcuguuguggugugcaa

SEQ ID NO: 511 - RNA, 23 nt, Artificial sequence
  >hsa-miR-3065-3p MIMAT0015378 Homo sapiens miR-3065-3p
ucagcaccaggauauuguuggag

SEQ ID NO: 512 - RNA, 23 nt, Artificial sequence
  >hsa-miR-3065-5p MIMAT0015066 Homo sapiens miR-3065-5p
ucaacaaaaucacugaugcugga

SEQ ID NO: 513 - RNA, 22 nt, Artificial sequence
  >hsa-miR-3074-3p MIMAT0015027 Homo sapiens miR-3074-3p
gauaucagcucaguaggcaccg

SEQ ID NO: 514 - RNA, 21 nt, Artificial sequence
  >hsa-miR-3074-5p MIMAT0019208 Homo sapiens miR-3074-5p
guuccugcugaacugagccag

SEQ ID NO: 515 - RNA, 22 nt, Artificial sequence
  >hsa-miR-30a-3p MIMAT0000088 Homo sapiens miR-30a-3p
cuuucagucggauguuugcagc

SEQ ID NO: 516 - RNA, 22 nt, Artificial sequence
  >hsa-miR-30a-5p MIMAT0000087 Homo sapiens miR-30a-5p
uguaaacauccucgacuggaag

SEQ ID NO: 517 - RNA, 22 nt, Artificial sequence
  >hsa-miR-30b-3p MIMAT0004589 Homo sapiens miR-30b-3p
cugggagguggauguuuacuuc

SEQ ID NO: 518 - RNA, 22 nt, Artificial sequence
  >hsa-miR-30b-5p MIMAT0000420 Homo sapiens miR-30b-5p
uguaaacauccuacacucagcu

SEQ ID NO: 519 - RNA, 22 nt, Artificial sequence
  >hsa-miR-30c-1-3p MIMAT0004674 Homo sapiens miR-30c-1-3p
cugggagaggguuguuuacucc

SEQ ID NO: 520 - RNA, 22 nt, Artificial sequence
  >hsa-miR-30c-2-3p MIMAT0004550 Homo sapiens miR-30c-2-3p
cugggagaaggcuguuuacucu

SEQ ID NO: 521 - RNA, 23 nt, Artificial sequence
  >hsa-miR-30c-5p MIMAT0000244 Homo sapiens miR-30c-5p
uguaaacauccuacacucucagc

SEQ ID NO: 522 - RNA, 22 nt, Artificial sequence
  >hsa-miR-30d-3p MIMAT0004551 Homo sapiens miR-30d-3p
cuuucagucagauguuugcugc

SEQ ID NO: 523 - RNA, 22 nt, Artificial sequence
  >hsa-miR-30d-5p MIMAT0000245 Homo sapiens miR-30d-5p
uguaaacauccccgacuggaag

SEQ ID NO: 524 - RNA, 22 nt, Artificial sequence
  >hsa-miR-30e-3p MIMAT0000693 Homo sapiens miR-30e-3p
cuuucagucggauguuuacagc

SEQ ID NO: 525 - RNA, 22 nt, Artificial sequence
  >hsa-miR-30e-5p MIMAT0000692 Homo sapiens miR-30e-5p
uguaaacauccuugacuggaag

SEQ ID NO: 526 - RNA, 22 nt, Artificial sequence
  >hsa-miR-31-3p MIMAT0004504 Homo sapiens miR-31-3p
ugcuaugccaacauauugccau

SEQ ID NO: 527 - RNA, 21 nt, Artificial sequence
  >hsa-miR-31-5p MIMAT0000089 Homo sapiens miR-31-5p
aggcaagaugcuggcauagcu

SEQ ID NO: 528 - RNA, 20 nt, Artificial sequence
  >hsa-miR-3115 MIMAT0014977 Homo sapiens miR-3115
auauggguuuacuaguuggu

SEQ ID NO: 529 - RNA, 22 nt, Artificial sequence
  >hsa-miR-3116 MIMAT0014978 Homo sapiens miR-3116
ugccuggaacauaguagggacu

SEQ ID NO: 530 - RNA, 21 nt, Artificial sequence
  >hsa-miR-3117-3p MIMAT0014979 Homo sapiens miR-3117-3p
auaggacucauauagugccag

SEQ ID NO: 531 - RNA, 20 nt, Artificial sequence
  >hsa-miR-3117-5p MIMAT0019197 Homo sapiens miR-3117-5p
agacacuauacgagucauau

SEQ ID NO: 532 - RNA, 23 nt, Artificial sequence
  >hsa-miR-3118 MIMAT0014980 Homo sapiens miR-3118
ugugacugcauuaugaaaauucu

SEQ ID NO: 533 - RNA, 20 nt, Artificial sequence
  >hsa-miR-3119 MIMAT0014981 Homo sapiens miR-3119
uggcuuuuaacuuugauggc

SEQ ID NO: 534 - RNA, 21 nt, Artificial sequence
  >hsa-miR-3120-3p MIMAT0014982 Homo sapiens miR-3120-3p
cacagcaaguguagacaggca

SEQ ID NO: 535 - RNA, 21 nt, Artificial sequence
  >hsa-miR-3120-5p MIMAT0019198 Homo sapiens miR-3120-5p
ccugucugugccugcuguaca

SEQ ID NO: 536 - RNA, 22 nt, Artificial sequence
  >hsa-miR-3121-3p MIMAT0014983 Homo sapiens miR-3121-3p
uaaauagaguaggcaaaggaca

SEQ ID NO: 537 - RNA, 22 nt, Artificial sequence
  >hsa-miR-3121-5p MIMAT0019199 Homo sapiens miR-3121-5p
uccuuugccuauucuauuuaag

SEQ ID NO: 538 - RNA, 22 nt, Artificial sequence
  >hsa-miR-3122 MIMAT0014984 Homo sapiens miR-3122
guugggacaagaggacggucuu

SEQ ID NO: 539 - RNA, 17 nt, Artificial sequence
  >hsa-miR-3123 MIMAT0014985 Homo sapiens miR-3123
cagagaauuguuuaauc

SEQ ID NO: 540 - RNA, 22 nt, Artificial sequence
  >hsa-miR-3124-3p MIMAT0019200 Homo sapiens miR-3124-3p
acuuuccucacucccgugaagu

SEQ ID NO: 541 - RNA, 21 nt, Artificial sequence
  >hsa-miR-3124-5p MIMAT0014986 Homo sapiens miR-3124-5p
uucgcgggcgaaggcaaaguc

SEQ ID NO: 542 - RNA, 20 nt, Artificial sequence
  >hsa-miR-3125 MIMAT0014988 Homo sapiens miR-3125
uagaggaagcuguggagaga

SEQ ID NO: 543 - RNA, 22 nt, Artificial sequence
  >hsa-miR-3126-3p MIMAT0015377 Homo sapiens miR-3126-3p
caucuggcauccgucacacaga

SEQ ID NO: 544 - RNA, 22 nt, Artificial sequence
  >hsa-miR-3126-5p MIMAT0014989 Homo sapiens miR-3126-5p
ugagggacagaugccagaagca

SEQ ID NO: 545 - RNA, 22 nt, Artificial sequence
  >hsa-miR-3127-3p MIMAT0019201 Homo sapiens miR-3127-3p
uccccuucugcaggccugcugg

SEQ ID NO: 546 - RNA, 23 nt, Artificial sequence
  >hsa-miR-3127-5p MIMAT0014990 Homo sapiens miR-3127-5p
aucagggcuuguggaaugggaag

SEQ ID NO: 547 - RNA, 23 nt, Artificial sequence
  >hsa-miR-3128 MIMAT0014991 Homo sapiens miR-3128
ucuggcaaguaaaaaacucucau

SEQ ID NO: 548 - RNA, 22 nt, Artificial sequence
  >hsa-miR-3129-3p MIMAT0019202 Homo sapiens miR-3129-3p
aaacuaaucucuacacugcugc

SEQ ID NO: 549 - RNA, 22 nt, Artificial sequence
  >hsa-miR-3129-5p MIMAT0014992 Homo sapiens miR-3129-5p
gcaguaguguagagauugguuu

SEQ ID NO: 550 - RNA, 21 nt, Artificial sequence
  >hsa-miR-3130-3p MIMAT0014994 Homo sapiens miR-3130-3p
gcugcaccggagacuggguaa

SEQ ID NO: 551 - RNA, 21 nt, Artificial sequence
  >hsa-miR-3130-5p MIMAT0014995 Homo sapiens miR-3130-5p
uacccagucuccggugcagcc

SEQ ID NO: 552 - RNA, 23 nt, Artificial sequence
  >hsa-miR-3131 MIMAT0014996 Homo sapiens miR-3131
ucgaggacugguggaagggccuu

SEQ ID NO: 553 - RNA, 24 nt, Artificial sequence
  >hsa-miR-3132 MIMAT0014997 Homo sapiens miR-3132
uggguagagaaggagcucagagga

SEQ ID NO: 554 - RNA, 22 nt, Artificial sequence
  >hsa-miR-3133 MIMAT0014998 Homo sapiens miR-3133
uaaagaacucuuaaaacccaau

SEQ ID NO: 555 - RNA, 23 nt, Artificial sequence
  >hsa-miR-3134 MIMAT0015000 Homo sapiens miR-3134
ugauggauaaaagacuacauauu

SEQ ID NO: 556 - RNA, 22 nt, Artificial sequence
  >hsa-miR-3135a MIMAT0015001 Homo sapiens miR-3135a
ugccuaggcugagacugcagug

SEQ ID NO: 557 - RNA, 22 nt, Artificial sequence
  >hsa-miR-3135b MIMAT0018985 Homo sapiens miR-3135b
ggcuggagcgagugcaguggug

SEQ ID NO: 558 - RNA, 22 nt, Artificial sequence
  >hsa-miR-3136-3p MIMAT0019203 Homo sapiens miR-3136-3p
uggcccaaccuauucaguuagu

SEQ ID NO: 559 - RNA, 23 nt, Artificial sequence
  >hsa-miR-3136-5p MIMAT0015003 Homo sapiens miR-3136-5p
cugacugaauagguagggucauu

SEQ ID NO: 560 - RNA, 24 nt, Artificial sequence
  >hsa-miR-3137 MIMAT0015005 Homo sapiens miR-3137
ucuguagccugggagcaauggggu

SEQ ID NO: 561 - RNA, 24 nt, Artificial sequence
  >hsa-miR-3138 MIMAT0015006 Homo sapiens miR-3138
uguggacagugagguagagggagu

SEQ ID NO: 562 - RNA, 23 nt, Artificial sequence
  >hsa-miR-3139 MIMAT0015007 Homo sapiens miR-3139
uaggagcucaacagaugccuguu

SEQ ID NO: 563 - RNA, 22 nt, Artificial sequence
  >hsa-miR-3140-3p MIMAT0015008 Homo sapiens miR-3140-3p
agcuuuugggaauucagguagu

SEQ ID NO: 564 - RNA, 21 nt, Artificial sequence
  >hsa-miR-3140-5p MIMAT0019204 Homo sapiens miR-3140-5p
accugaauuaccaaaagcuuu

SEQ ID NO: 565 - RNA, 19 nt, Artificial sequence
  >hsa-miR-3141 MIMAT0015010 Homo sapiens miR-3141
gagggcggguggaggagga

SEQ ID NO: 566 - RNA, 22 nt, Artificial sequence
  >hsa-miR-3142 MIMAT0015011 Homo sapiens miR-3142
aaggccuuucugaaccuucaga

SEQ ID NO: 567 - RNA, 25 nt, Artificial sequence
  >hsa-miR-3143 MIMAT0015012 Homo sapiens miR-3143
auaacauuguaaagcgcuucuuucg

SEQ ID NO: 568 - RNA, 22 nt, Artificial sequence
  >hsa-miR-3144-3p MIMAT0015015 Homo sapiens miR-3144-3p
auauaccuguucggucucuuua

SEQ ID NO: 569 - RNA, 22 nt, Artificial sequence
  >hsa-miR-3144-5p MIMAT0015014 Homo sapiens miR-3144-5p
aggggaccaaagagauauauag

SEQ ID NO: 570 - RNA, 24 nt, Artificial sequence
  >hsa-miR-3145-3p MIMAT0015016 Homo sapiens miR-3145-3p
agauauuuugaguguuuggaauug

SEQ ID NO: 571 - RNA, 22 nt, Artificial sequence
  >hsa-miR-3145-5p MIMAT0019205 Homo sapiens miR-3145-5p
aacuccaaacacucaaaacuca

SEQ ID NO: 572 - RNA, 22 nt, Artificial sequence
  >hsa-miR-3146 MIMAT0015018 Homo sapiens miR-3146
caugcuaggauagaaagaaugg

SEQ ID NO: 573 - RNA, 24 nt, Artificial sequence
  >hsa-miR-3147 MIMAT0015019 Homo sapiens miR-3147
gguugggcagugaggaggguguga

SEQ ID NO: 574 - RNA, 22 nt, Artificial sequence
  >hsa-miR-3148 MIMAT0015021 Homo sapiens miR-3148
uggaaaaaacuggugugugcuu

SEQ ID NO: 575 - RNA, 23 nt, Artificial sequence
  >hsa-miR-3149 MIMAT0015022 Homo sapiens miR-3149
uuuguauggauauguguguguau

SEQ ID NO: 576 - RNA, 22 nt, Artificial sequence
  >hsa-miR-3150a-3p MIMAT0015023 Homo sapiens miR-3150a-3p
cuggggagauccucgagguugg

SEQ ID NO: 577 - RNA, 22 nt, Artificial sequence
  >hsa-miR-3150a-5p MIMAT0019206 Homo sapiens miR-3150a-5p
caaccucgacgaucuccucagc

SEQ ID NO: 578 - RNA, 21 nt, Artificial sequence
  >hsa-miR-3150b-3p MIMAT0018194 Homo sapiens miR-3150b-3p
ugaggagaucgucgagguugg

SEQ ID NO: 579 - RNA, 22 nt, Artificial sequence
  >hsa-miR-3150b-5p MIMAT0019226 Homo sapiens miR-3150b-5p
caaccucgaggaucuccccagc

SEQ ID NO: 580 - RNA, 20 nt, Artificial sequence
  >hsa-miR-3151-3p MIMAT0027026 Homo sapiens miR-3151-3p
ccugaucccacagcccaccu

SEQ ID NO: 581 - RNA, 21 nt, Artificial sequence
  >hsa-miR-3151-5p MIMAT0015024 Homo sapiens miR-3151-5p
gguggggcaaugggaucaggu

SEQ ID NO: 582 - RNA, 22 nt, Artificial sequence
  >hsa-miR-3152-3p MIMAT0015025 Homo sapiens miR-3152-3p
uguguuagaauaggggcaauaa

SEQ ID NO: 583 - RNA, 22 nt, Artificial sequence
  >hsa-miR-3152-5p MIMAT0019207 Homo sapiens miR-3152-5p
auugccucuguucuaacacaag

SEQ ID NO: 584 - RNA, 23 nt, Artificial sequence
  >hsa-miR-3153 MIMAT0015026 Homo sapiens miR-3153
ggggaaagcgaguagggacauuu

SEQ ID NO: 585 - RNA, 22 nt, Artificial sequence
  >hsa-miR-3154 MIMAT0015028 Homo sapiens miR-3154
cagaaggggaguugggagcaga

SEQ ID NO: 586 - RNA, 21 nt, Artificial sequence
  >hsa-miR-3155a MIMAT0015029 Homo sapiens miR-3155a
ccaggcucugcagugggaacu

SEQ ID NO: 587 - RNA, 18 nt, Artificial sequence
  >hsa-miR-3155b MIMAT0019012 Homo sapiens miR-3155b
ccaggcucugcaguggga

SEQ ID NO: 588 - RNA, 21 nt, Artificial sequence
  >hsa-miR-3156-3p MIMAT0019209 Homo sapiens miR-3156-3p
cucccacuuccagaucuuucu

SEQ ID NO: 589 - RNA, 22 nt, Artificial sequence
  >hsa-miR-3156-5p MIMAT0015030 Homo sapiens miR-3156-5p
aaagaucuggaagugggagaca

SEQ ID NO: 590 - RNA, 22 nt, Artificial sequence
  >hsa-miR-3157-3p MIMAT0019210 Homo sapiens miR-3157-3p
cugcccuagucuagcugaagcu

SEQ ID NO: 591 - RNA, 22 nt, Artificial sequence
  >hsa-miR-3157-5p MIMAT0015031 Homo sapiens miR-3157-5p
uucagccaggcuagugcagucu

SEQ ID NO: 592 - RNA, 22 nt, Artificial sequence
  >hsa-miR-3158-3p MIMAT0015032 Homo sapiens miR-3158-3p
aagggcuuccucucugcaggac

SEQ ID NO: 593 - RNA, 21 nt, Artificial sequence
  >hsa-miR-3158-5p MIMAT0019211 Homo sapiens miR-3158-5p
ccugcagagaggaagcccuuc

SEQ ID NO: 594 - RNA, 22 nt, Artificial sequence
  >hsa-miR-3159 MIMAT0015033 Homo sapiens miR-3159
uaggauuacaagugucggccac

SEQ ID NO: 595 - RNA, 22 nt, Artificial sequence
  >hsa-miR-3160-3p MIMAT0015034 Homo sapiens miR-3160-3p
agagcugagacuagaaagccca

SEQ ID NO: 596 - RNA, 22 nt, Artificial sequence
  >hsa-miR-3160-5p MIMAT0019212 Homo sapiens miR-3160-5p
ggcuuucuagucucagcucucc

SEQ ID NO: 597 - RNA, 23 nt, Artificial sequence
  >hsa-miR-3161 MIMAT0015035 Homo sapiens miR-3161
cugauaagaacagaggcccagau

SEQ ID NO: 598 - RNA, 21 nt, Artificial sequence
  >hsa-miR-3162-3p MIMAT0019213 Homo sapiens miR-3162-3p
ucccuaccccuccacucccca

SEQ ID NO: 599 - RNA, 23 nt, Artificial sequence
  >hsa-miR-3162-5p MIMAT0015036 Homo sapiens miR-3162-5p
uuagggaguagaaggguggggag

SEQ ID NO: 600 - RNA, 22 nt, Artificial sequence
  >hsa-miR-3163 MIMAT0015037 Homo sapiens miR-3163
uauaaaaugagggcaguaagac

SEQ ID NO: 601 - RNA, 22 nt, Artificial sequence
  >hsa-miR-3164 MIMAT0015038 Homo sapiens miR-3164
ugugacuuuaagggaaauggcg

SEQ ID NO: 602 - RNA, 22 nt, Artificial sequence
  >hsa-miR-3165 MIMAT0015039 Homo sapiens miR-3165
agguggaugcaaugugaccuca

SEQ ID NO: 603 - RNA, 23 nt, Artificial sequence
  >hsa-miR-3166 MIMAT0015040 Homo sapiens miR-3166
cgcagacaaugccuacuggccua

SEQ ID NO: 604 - RNA, 22 nt, Artificial sequence
  >hsa-miR-3167 MIMAT0015042 Homo sapiens miR-3167
aggauuucagaaauacuggugu

SEQ ID NO: 605 - RNA, 17 nt, Artificial sequence
  >hsa-miR-3168 MIMAT0015043 Homo sapiens miR-3168
gaguucuacagucagac

SEQ ID NO: 606 - RNA, 22 nt, Artificial sequence
  >hsa-miR-3169 MIMAT0015044 Homo sapiens miR-3169
uaggacugugcuuggcacauag

SEQ ID NO: 607 - RNA, 22 nt, Artificial sequence
  >hsa-miR-3170 MIMAT0015045 Homo sapiens miR-3170
cugggguucugagacagacagu

SEQ ID NO: 608 - RNA, 24 nt, Artificial sequence
  >hsa-miR-3171 MIMAT0015046 Homo sapiens miR-3171
agauguauggaaucuguauauauc

SEQ ID NO: 609 - RNA, 22 nt, Artificial sequence
  >hsa-miR-3173-3p MIMAT0015048 Homo sapiens miR-3173-3p
aaaggaggaaauaggcaggcca

SEQ ID NO: 610 - RNA, 22 nt, Artificial sequence
  >hsa-miR-3173-5p MIMAT0019214 Homo sapiens miR-3173-5p
ugcccugccuguuuucuccuuu

SEQ ID NO: 611 - RNA, 23 nt, Artificial sequence
  >hsa-miR-3174 MIMAT0015051 Homo sapiens miR-3174
uagugaguuagagaugcagagcc

SEQ ID NO: 612 - RNA, 22 nt, Artificial sequence
  >hsa-miR-3175 MIMAT0015052 Homo sapiens miR-3175
cggggagagaacgcagugacgu

SEQ ID NO: 613 - RNA, 19 nt, Artificial sequence
  >hsa-miR-3176 MIMAT0015053 Homo sapiens miR-3176
acuggccugggacuaccgg

SEQ ID NO: 614 - RNA, 21 nt, Artificial sequence
  >hsa-miR-3177-3p MIMAT0015054 Homo sapiens miR-3177-3p
ugcacggcacuggggacacgu

SEQ ID NO: 615 - RNA, 23 nt, Artificial sequence
  >hsa-miR-3177-5p MIMAT0019215 Homo sapiens miR-3177-5p
uguguacacacgugccaggcgcu

SEQ ID NO: 616 - RNA, 17 nt, Artificial sequence
  >hsa-miR-3178 MIMAT0015055 Homo sapiens miR-3178
ggggcgcggccggaucg

SEQ ID NO: 617 - RNA, 22 nt, Artificial sequence
  >hsa-miR-3179 MIMAT0015056 Homo sapiens miR-3179
agaaggggugaaauuuaaacgu

SEQ ID NO: 618 - RNA, 19 nt, Artificial sequence
  >hsa-miR-3180 MIMAT0018178 Homo sapiens miR-3180
uggggcggagcuuccggag

SEQ ID NO: 619 - RNA, 22 nt, Artificial sequence
  >hsa-miR-3180-3p MIMAT0015058 Homo sapiens miR-3180-3p
uggggcggagcuuccggaggcc

SEQ ID NO: 620 - RNA, 25 nt, Artificial sequence
  >hsa-miR-3180-5p MIMAT0015057 Homo sapiens miR-3180-5p
cuuccagacgcuccgccccacgucg

SEQ ID NO: 621 - RNA, 19 nt, Artificial sequence
  >hsa-miR-3181 MIMAT0015061 Homo sapiens miR-3181
aucgggcccucggcgccgg

SEQ ID NO: 622 - RNA, 17 nt, Artificial sequence
  >hsa-miR-3182 MIMAT0015062 Homo sapiens miR-3182
gcuucuguaguguaguc

SEQ ID NO: 623 - RNA, 22 nt, Artificial sequence
  >hsa-miR-3183 MIMAT0015063 Homo sapiens miR-3183
gccucucucggagucgcucgga

SEQ ID NO: 624 - RNA, 23 nt, Artificial sequence
  >hsa-miR-3184-3p MIMAT0022731 Homo sapiens miR-3184-3p
aaagucucgcucucugccccuca

SEQ ID NO: 625 - RNA, 24 nt, Artificial sequence
  >hsa-miR-3184-5p MIMAT0015064 Homo sapiens miR-3184-5p
ugaggggccucagaccgagcuuuu

SEQ ID NO: 626 - RNA, 23 nt, Artificial sequence
  >hsa-miR-3185 MIMAT0015065 Homo sapiens miR-3185
agaagaaggcggucggucugcgg

SEQ ID NO: 627 - RNA, 21 nt, Artificial sequence
  >hsa-miR-3186-3p MIMAT0015068 Homo sapiens miR-3186-3p
ucacgcggagagauggcuuug

SEQ ID NO: 628 - RNA, 22 nt, Artificial sequence
  >hsa-miR-3186-5p MIMAT0015067 Homo sapiens miR-3186-5p
caggcgucugucuacguggcuu

SEQ ID NO: 629 - RNA, 20 nt, Artificial sequence
  >hsa-miR-3187-3p MIMAT0015069 Homo sapiens miR-3187-3p
uuggccauggggcugcgcgg

SEQ ID NO: 630 - RNA, 23 nt, Artificial sequence
  >hsa-miR-3187-5p MIMAT0019216 Homo sapiens miR-3187-5p
ccugggcagcguguggcugaagg

SEQ ID NO: 631 - RNA, 23 nt, Artificial sequence
  >hsa-miR-3188 MIMAT0015070 Homo sapiens miR-3188
agaggcuuugugcggauacgggg

SEQ ID NO: 632 - RNA, 21 nt, Artificial sequence
  >hsa-miR-3189-3p MIMAT0015071 Homo sapiens miR-3189-3p
cccuugggucugaugggguag

SEQ ID NO: 633 - RNA, 25 nt, Artificial sequence
  >hsa-miR-3189-5p MIMAT0019217 Homo sapiens miR-3189-5p
ugccccaucugugcccuggguagga

SEQ ID NO: 634 - RNA, 23 nt, Artificial sequence
  >hsa-miR-3190-3p MIMAT0022839 Homo sapiens miR-3190-3p
uguggaagguagacggccagaga

SEQ ID NO: 635 - RNA, 20 nt, Artificial sequence
  >hsa-miR-3190-5p MIMAT0015073 Homo sapiens miR-3190-5p
ucuggccagcuacgucccca

SEQ ID NO: 636 - RNA, 23 nt, Artificial sequence
  >hsa-miR-3191-3p MIMAT0015075 Homo sapiens miR-3191-3p
uggggacguagcuggccagacag

SEQ ID NO: 637 - RNA, 22 nt, Artificial sequence
  >hsa-miR-3191-5p MIMAT0022732 Homo sapiens miR-3191-5p
cucucuggccgucuaccuucca

SEQ ID NO: 638 - RNA, 21 nt, Artificial sequence
  >hsa-miR-3192-3p MIMAT0027027 Homo sapiens miR-3192-3p
cucugaucgcccucucagcuc

SEQ ID NO: 639 - RNA, 23 nt, Artificial sequence
  >hsa-miR-3192-5p MIMAT0015076 Homo sapiens miR-3192-5p
ucugggagguuguagcaguggaa

SEQ ID NO: 640 - RNA, 22 nt, Artificial sequence
  >hsa-miR-3193 MIMAT0015077 Homo sapiens miR-3193
uccugcguaggaucugaggagu

SEQ ID NO: 641 - RNA, 22 nt, Artificial sequence
  >hsa-miR-3194-3p MIMAT0019218 Homo sapiens miR-3194-3p
agcucugcugcucacuggcagu

SEQ ID NO: 642 - RNA, 21 nt, Artificial sequence
  >hsa-miR-3194-5p MIMAT0015078 Homo sapiens miR-3194-5p
ggccagccaccaggagggcug

SEQ ID NO: 643 - RNA, 17 nt, Artificial sequence
  >hsa-miR-3195 MIMAT0015079 Homo sapiens miR-3195
cgcgccgggcccggguu

SEQ ID NO: 644 - RNA, 18 nt, Artificial sequence
  >hsa-miR-3196 MIMAT0015080 Homo sapiens miR-3196
cggggcggcaggggccuc

SEQ ID NO: 645 - RNA, 23 nt, Artificial sequence
  >hsa-miR-3197 MIMAT0015082 Homo sapiens miR-3197
ggaggcgcaggcucggaaaggcg

SEQ ID NO: 646 - RNA, 22 nt, Artificial sequence
  >hsa-miR-3198 MIMAT0015083 Homo sapiens miR-3198
guggaguccuggggaauggaga

SEQ ID NO: 647 - RNA, 23 nt, Artificial sequence
  >hsa-miR-3199 MIMAT0015084 Homo sapiens miR-3199
agggacugccuuaggagaaaguu

SEQ ID NO: 648 - RNA, 22 nt, Artificial sequence
  >hsa-miR-32-3p MIMAT0004505 Homo sapiens miR-32-3p
caauuuagugugugugauauuu

SEQ ID NO: 649 - RNA, 22 nt, Artificial sequence
  >hsa-miR-32-5p MIMAT0000090 Homo sapiens miR-32-5p
uauugcacauuacuaaguugca

SEQ ID NO: 650 - RNA, 22 nt, Artificial sequence
  >hsa-miR-3200-3p MIMAT0015085 Homo sapiens miR-3200-3p
caccuugcgcuacucaggucug

SEQ ID NO: 651 - RNA, 22 nt, Artificial sequence
  >hsa-miR-3200-5p MIMAT0017392 Homo sapiens miR-3200-5p
aaucugagaaggcgcacaaggu

SEQ ID NO: 652 - RNA, 17 nt, Artificial sequence
  >hsa-miR-3201 MIMAT0015086 Homo sapiens miR-3201
gggauaugaagaaaaau

SEQ ID NO: 653 - RNA, 22 nt, Artificial sequence
  >hsa-miR-3202 MIMAT0015089 Homo sapiens miR-3202
uggaagggagaagagcuuuaau

SEQ ID NO: 654 - RNA, 22 nt, Artificial sequence
  >hsa-miR-320a MIMAT0000510 Homo sapiens miR-320a
aaaagcuggguugagagggcga

SEQ ID NO: 655 - RNA, 22 nt, Artificial sequence
  >hsa-miR-320b MIMAT0005792 Homo sapiens miR-320b
aaaagcuggguugagagggcaa

SEQ ID NO: 656 - RNA, 20 nt, Artificial sequence
  >hsa-miR-320c MIMAT0005793 Homo sapiens miR-320c
aaaagcuggguugagagggu

SEQ ID NO: 657 - RNA, 19 nt, Artificial sequence
  >hsa-miR-320d MIMAT0006764 Homo sapiens miR-320d
aaaagcuggguugagagga

SEQ ID NO: 658 - RNA, 18 nt, Artificial sequence
  >hsa-miR-320e MIMAT0015072 Homo sapiens miR-320e
aaagcuggguugagaagg

SEQ ID NO: 659 - RNA, 21 nt, Artificial sequence
  >hsa-miR-323a-3p MIMAT0000755 Homo sapiens miR-323a-3p
cacauuacacggucgaccucu

SEQ ID NO: 660 - RNA, 22 nt, Artificial sequence
  >hsa-miR-323a-5p MIMAT0004696 Homo sapiens miR-323a-5p
aggugguccguggcgcguucgc

SEQ ID NO: 661 - RNA, 22 nt, Artificial sequence
  >hsa-miR-323b-3p MIMAT0015050 Homo sapiens miR-323b-3p
cccaauacacggucgaccucuu

SEQ ID NO: 662 - RNA, 23 nt, Artificial sequence
  >hsa-miR-323b-5p MIMAT0001630 Homo sapiens miR-323b-5p
agguuguccguggugaguucgca

SEQ ID NO: 663 - RNA, 20 nt, Artificial sequence
  >hsa-miR-324-3p MIMAT0000762 Homo sapiens miR-324-3p
acugccccaggugcugcugg

SEQ ID NO: 664 - RNA, 23 nt, Artificial sequence
  >hsa-miR-324-5p MIMAT0000761 Homo sapiens miR-324-5p
cgcauccccuagggcauuggugu

SEQ ID NO: 665 - RNA, 23 nt, Artificial sequence
  >hsa-miR-325 MIMAT0000771 Homo sapiens miR-325
ccuaguagguguccaguaagugu

SEQ ID NO: 666 - RNA, 20 nt, Artificial sequence
  >hsa-miR-326 MIMAT0000756 Homo sapiens miR-326
ccucugggcccuuccuccag

SEQ ID NO: 667 - RNA, 22 nt, Artificial sequence
  >hsa-miR-328-3p MIMAT0000752 Homo sapiens miR-328-3p
cuggcccucucugcccuuccgu

SEQ ID NO: 668 - RNA, 23 nt, Artificial sequence
  >hsa-miR-328-5p MIMAT0026486 Homo sapiens miR-328-5p
gggggggcaggaggggcucaggg

SEQ ID NO: 669 - RNA, 22 nt, Artificial sequence
  >hsa-miR-329-3p MIMAT0001629 Homo sapiens miR-329-3p
aacacaccugguuaaccucuuu

SEQ ID NO: 670 - RNA, 23 nt, Artificial sequence
  >hsa-miR-329-5p MIMAT0026555 Homo sapiens miR-329-5p
gagguuuucuggguuucuguuuc

SEQ ID NO: 671 - RNA, 23 nt, Artificial sequence
  >hsa-miR-330-3p MIMAT0000751 Homo sapiens miR-330-3p
gcaaagcacacggccugcagaga

SEQ ID NO: 672 - RNA, 22 nt, Artificial sequence
  >hsa-miR-330-5p MIMAT0004693 Homo sapiens miR-330-5p
ucucugggccugugucuuaggc

SEQ ID NO: 673 - RNA, 21 nt, Artificial sequence
  >hsa-miR-331-3p MIMAT0000760 Homo sapiens miR-331-3p
gccccugggccuauccuagaa

SEQ ID NO: 674 - RNA, 22 nt, Artificial sequence
  >hsa-miR-331-5p MIMAT0004700 Homo sapiens miR-331-5p
cuagguauggucccagggaucc

SEQ ID NO: 675 - RNA, 22 nt, Artificial sequence
  >hsa-miR-335-3p MIMAT0004703 Homo sapiens miR-335-3p
uuuuucauuauugcuccugacc

SEQ ID NO: 676 - RNA, 23 nt, Artificial sequence
  >hsa-miR-335-5p MIMAT0000765 Homo sapiens miR-335-5p
ucaagagcaauaacgaaaaaugu

SEQ ID NO: 677 - RNA, 22 nt, Artificial sequence
  >hsa-miR-337-3p MIMAT0000754 Homo sapiens miR-337-3p
cuccuauaugaugccuuucuuc

SEQ ID NO: 678 - RNA, 21 nt, Artificial sequence
  >hsa-miR-337-5p MIMAT0004695 Homo sapiens miR-337-5p
gaacggcuucauacaggaguu

SEQ ID NO: 679 - RNA, 22 nt, Artificial sequence
  >hsa-miR-338-3p MIMAT0000763 Homo sapiens miR-338-3p
uccagcaucagugauuuuguug

SEQ ID NO: 680 - RNA, 22 nt, Artificial sequence
  >hsa-miR-338-5p MIMAT0004701 Homo sapiens miR-338-5p
aacaauauccuggugcugagug

SEQ ID NO: 681 - RNA, 23 nt, Artificial sequence
  >hsa-miR-339-3p MIMAT0004702 Homo sapiens miR-339-3p
ugagcgccucgacgacagagccg

SEQ ID NO: 682 - RNA, 23 nt, Artificial sequence
  >hsa-miR-339-5p MIMAT0000764 Homo sapiens miR-339-5p
ucccuguccuccaggagcucacg

SEQ ID NO: 683 - RNA, 22 nt, Artificial sequence
  >hsa-miR-33a-3p MIMAT0004506 Homo sapiens miR-33a-3p
caauguuuccacagugcaucac

SEQ ID NO: 684 - RNA, 21 nt, Artificial sequence
  >hsa-miR-33a-5p MIMAT0000091 Homo sapiens miR-33a-5p
gugcauuguaguugcauugca

SEQ ID NO: 685 - RNA, 22 nt, Artificial sequence
  >hsa-miR-33b-3p MIMAT0004811 Homo sapiens miR-33b-3p
cagugccucggcagugcagccc

SEQ ID NO: 686 - RNA, 20 nt, Artificial sequence
  >hsa-miR-33b-5p MIMAT0003301 Homo sapiens miR-33b-5p
gugcauugcuguugcauugc

SEQ ID NO: 687 - RNA, 22 nt, Artificial sequence
  >hsa-miR-340-3p MIMAT0000750 Homo sapiens miR-340-3p
uccgucucaguuacuuuauagc

SEQ ID NO: 688 - RNA, 22 nt, Artificial sequence
  >hsa-miR-340-5p MIMAT0004692 Homo sapiens miR-340-5p
uuauaaagcaaugagacugauu

SEQ ID NO: 689 - RNA, 23 nt, Artificial sequence
  >hsa-miR-342-3p MIMAT0000753 Homo sapiens miR-342-3p
ucucacacagaaaucgcacccgu

SEQ ID NO: 690 - RNA, 21 nt, Artificial sequence
  >hsa-miR-342-5p MIMAT0004694 Homo sapiens miR-342-5p
aggggugcuaucugugauuga

SEQ ID NO: 691 - RNA, 22 nt, Artificial sequence
  >hsa-miR-345-3p MIMAT0022698 Homo sapiens miR-345-3p
gcccugaacgaggggucuggag

SEQ ID NO: 692 - RNA, 22 nt, Artificial sequence
  >hsa-miR-345-5p MIMAT0000772 Homo sapiens miR-345-5p
gcugacuccuaguccagggcuc

SEQ ID NO: 693 - RNA, 23 nt, Artificial sequence
  >hsa-miR-346 MIMAT0000773 Homo sapiens miR-346
ugucugcccgcaugccugccucu

SEQ ID NO: 694 - RNA, 22 nt, Artificial sequence
  >hsa-miR-34a-3p MIMAT0004557 Homo sapiens miR-34a-3p
caaucagcaaguauacugcccu

SEQ ID NO: 695 - RNA, 22 nt, Artificial sequence
  >hsa-miR-34a-5p MIMAT0000255 Homo sapiens miR-34a-5p
uggcagugucuuagcugguugu

SEQ ID NO: 696 - RNA, 22 nt, Artificial sequence
  >hsa-miR-34b-3p MIMAT0004676 Homo sapiens miR-34b-3p
caaucacuaacuccacugccau

SEQ ID NO: 697 - RNA, 23 nt, Artificial sequence
  >hsa-miR-34b-5p MIMAT0000685 Homo sapiens miR-34b-5p
uaggcagugucauuagcugauug

SEQ ID NO: 698 - RNA, 22 nt, Artificial sequence
  >hsa-miR-34c-3p MIMAT0004677 Homo sapiens miR-34c-3p
aaucacuaaccacacggccagg

SEQ ID NO: 699 - RNA, 23 nt, Artificial sequence
  >hsa-miR-34c-5p MIMAT0000686 Homo sapiens miR-34c-5p
aggcaguguaguuagcugauugc

SEQ ID NO: 700 - RNA, 24 nt, Artificial sequence
  >hsa-miR-3529-3p MIMAT0022741 Homo sapiens miR-3529-3p
aacaacaaaaucacuagucuucca

SEQ ID NO: 701 - RNA, 22 nt, Artificial sequence
  >hsa-miR-3529-5p MIMAT0019828 Homo sapiens miR-3529-5p
agguagacugggauuuguuguu

SEQ ID NO: 702 - RNA, 22 nt, Artificial sequence
  >hsa-miR-3591-3p MIMAT0019877 Homo sapiens miR-3591-3p
aaacaccauugucacacuccac

SEQ ID NO: 703 - RNA, 23 nt, Artificial sequence
  >hsa-miR-3591-5p MIMAT0019876 Homo sapiens miR-3591-5p
uuuagugugauaauggcguuuga

SEQ ID NO: 704 - RNA, 23 nt, Artificial sequence
  >hsa-miR-3605-3p MIMAT0017982 Homo sapiens miR-3605-3p
ccuccguguuaccuguccucuag

SEQ ID NO: 705 - RNA, 23 nt, Artificial sequence
  >hsa-miR-3605-5p MIMAT0017981 Homo sapiens miR-3605-5p
ugaggauggauagcaaggaagcc

SEQ ID NO: 706 - RNA, 21 nt, Artificial sequence
  >hsa-miR-3606-3p MIMAT0022965 Homo sapiens miR-3606-3p
aaaauuucuuucacuacuuag

SEQ ID NO: 707 - RNA, 21 nt, Artificial sequence
  >hsa-miR-3606-5p MIMAT0017983 Homo sapiens miR-3606-5p
uuagugaaggcuauuuuaauu

SEQ ID NO: 708 - RNA, 20 nt, Artificial sequence
  >hsa-miR-3607-3p MIMAT0017985 Homo sapiens miR-3607-3p
acuguaaacgcuuucugaug

SEQ ID NO: 709 - RNA, 22 nt, Artificial sequence
  >hsa-miR-3607-5p MIMAT0017984 Homo sapiens miR-3607-5p
gcaugugaugaagcaaaucagu

SEQ ID NO: 710 - RNA, 24 nt, Artificial sequence
  >hsa-miR-3609 MIMAT0017986 Homo sapiens miR-3609
caaagugaugaguaauacuggcug

SEQ ID NO: 711 - RNA, 23 nt, Artificial sequence
  >hsa-miR-361-3p MIMAT0004682 Homo sapiens miR-361-3p
ucccccaggugugauucugauuu

SEQ ID NO: 712 - RNA, 22 nt, Artificial sequence
  >hsa-miR-361-5p MIMAT0000703 Homo sapiens miR-361-5p
uuaucagaaucuccagggguac

SEQ ID NO: 713 - RNA, 20 nt, Artificial sequence
  >hsa-miR-3610 MIMAT0017987 Homo sapiens miR-3610
gaaucggaaaggaggcgccg

SEQ ID NO: 714 - RNA, 21 nt, Artificial sequence
  >hsa-miR-3611 MIMAT0017988 Homo sapiens miR-3611
uugugaagaaagaaauucuua

SEQ ID NO: 715 - RNA, 22 nt, Artificial sequence
  >hsa-miR-3612 MIMAT0017989 Homo sapiens miR-3612
aggaggcaucuugagaaaugga

SEQ ID NO: 716 - RNA, 24 nt, Artificial sequence
  >hsa-miR-3613-3p MIMAT0017991 Homo sapiens miR-3613-3p
acaaaaaaaaaagcccaacccuuc

SEQ ID NO: 717 - RNA, 22 nt, Artificial sequence
  >hsa-miR-3613-5p MIMAT0017990 Homo sapiens miR-3613-5p
uguuguacuuuuuuuuuuguuc

SEQ ID NO: 718 - RNA, 23 nt, Artificial sequence
  >hsa-miR-3614-3p MIMAT0017993 Homo sapiens miR-3614-3p
uagccuucagaucuugguguuuu

SEQ ID NO: 719 - RNA, 23 nt, Artificial sequence
  >hsa-miR-3614-5p MIMAT0017992 Homo sapiens miR-3614-5p
ccacuuggaucugaaggcugccc

SEQ ID NO: 720 - RNA, 21 nt, Artificial sequence
  >hsa-miR-3615 MIMAT0017994 Homo sapiens miR-3615
ucucucggcuccucgcggcuc

SEQ ID NO: 721 - RNA, 23 nt, Artificial sequence
  >hsa-miR-3616-3p MIMAT0017996 Homo sapiens miR-3616-3p
cgagggcauuucaugaugcaggc

SEQ ID NO: 722 - RNA, 22 nt, Artificial sequence
  >hsa-miR-3616-5p MIMAT0017995 Homo sapiens miR-3616-5p
augaagugcacucaugauaugu

SEQ ID NO: 723 - RNA, 23 nt, Artificial sequence
  >hsa-miR-3617-3p MIMAT0022966 Homo sapiens miR-3617-3p
caucagcacccuauguccuuucu

SEQ ID NO: 724 - RNA, 22 nt, Artificial sequence
  >hsa-miR-3617-5p MIMAT0017997 Homo sapiens miR-3617-5p
aaagacauaguugcaagauggg

SEQ ID NO: 725 - RNA, 22 nt, Artificial sequence
  >hsa-miR-3618 MIMAT0017998 Homo sapiens miR-3618
ugucuacauuaaugaaaagagc

SEQ ID NO: 726 - RNA, 22 nt, Artificial sequence
  >hsa-miR-3619-3p MIMAT0019219 Homo sapiens miR-3619-3p
gggaccauccugccugcugugg

SEQ ID NO: 727 - RNA, 22 nt, Artificial sequence
  >hsa-miR-3619-5p MIMAT0017999 Homo sapiens miR-3619-5p
ucagcaggcaggcuggugcagc

SEQ ID NO: 728 - RNA, 22 nt, Artificial sequence
  >hsa-miR-362-3p MIMAT0004683 Homo sapiens miR-362-3p
aacacaccuauucaaggauuca

SEQ ID NO: 729 - RNA, 24 nt, Artificial sequence
  >hsa-miR-362-5p MIMAT0000705 Homo sapiens miR-362-5p
aauccuuggaaccuaggugugagu

SEQ ID NO: 730 - RNA, 22 nt, Artificial sequence
  >hsa-miR-3620-3p MIMAT0018001 Homo sapiens miR-3620-3p
ucacccugcaucccgcacccag

SEQ ID NO: 731 - RNA, 22 nt, Artificial sequence
  >hsa-miR-3620-5p MIMAT0022967 Homo sapiens miR-3620-5p
gugggcugggcugggcugggcc

SEQ ID NO: 732 - RNA, 20 nt, Artificial sequence
  >hsa-miR-3621 MIMAT0018002 Homo sapiens miR-3621
cgcgggucggggucugcagg

SEQ ID NO: 733 - RNA, 22 nt, Artificial sequence
  >hsa-miR-3622a-3p MIMAT0018004 Homo sapiens miR-3622a-3p
ucaccugaccucccaugccugu

SEQ ID NO: 734 - RNA, 22 nt, Artificial sequence
  >hsa-miR-3622a-5p MIMAT0018003 Homo sapiens miR-3622a-5p
caggcacgggagcucaggugag

SEQ ID NO: 735 - RNA, 21 nt, Artificial sequence
  >hsa-miR-3622b-3p MIMAT0018006 Homo sapiens miR-3622b-3p
ucaccugagcucccgugccug

SEQ ID NO: 736 - RNA, 20 nt, Artificial sequence
  >hsa-miR-3622b-5p MIMAT0018005 Homo sapiens miR-3622b-5p
aggcaugggaggucagguga

SEQ ID NO: 737 - RNA, 22 nt, Artificial sequence
  >hsa-miR-363-3p MIMAT0000707 Homo sapiens miR-363-3p
aauugcacgguauccaucugua

SEQ ID NO: 738 - RNA, 22 nt, Artificial sequence
  >hsa-miR-363-5p MIMAT0003385 Homo sapiens miR-363-5p
cggguggaucacgaugcaauuu

SEQ ID NO: 739 - RNA, 22 nt, Artificial sequence
  >hsa-miR-3646 MIMAT0018065 Homo sapiens miR-3646
aaaaugaaaugagcccagccca

SEQ ID NO: 740 - RNA, 21 nt, Artificial sequence
  >hsa-miR-3648 MIMAT0018068 Homo sapiens miR-3648
agccgcggggaucgccgaggg

SEQ ID NO: 741 - RNA, 19 nt, Artificial sequence
  >hsa-miR-3649 MIMAT0018069 Homo sapiens miR-3649
agggaccugagugucuaag

SEQ ID NO: 742 - RNA, 19 nt, Artificial sequence
  >hsa-miR-3650 MIMAT0018070 Homo sapiens miR-3650
aggugugucuguagagucc

SEQ ID NO: 743 - RNA, 24 nt, Artificial sequence
  >hsa-miR-3651 MIMAT0018071 Homo sapiens miR-3651
cauagcccggucgcugguacauga

SEQ ID NO: 744 - RNA, 18 nt, Artificial sequence
  >hsa-miR-3652 MIMAT0018072 Homo sapiens miR-3652
cggcuggaggugugagga

SEQ ID NO: 745 - RNA, 18 nt, Artificial sequence
  >hsa-miR-3653-3p MIMAT0018073 Homo sapiens miR-3653-3p
cuaagaaguugacugaag

SEQ ID NO: 746 - RNA, 20 nt, Artificial sequence
  >hsa-miR-3653-5p MIMAT0032110 Homo sapiens miR-3653-5p
ccuccugaugauucuucuuc

SEQ ID NO: 747 - RNA, 19 nt, Artificial sequence
  >hsa-miR-3654 MIMAT0018074 Homo sapiens miR-3654
gacuggacaagcugaggaa

SEQ ID NO: 748 - RNA, 21 nt, Artificial sequence
  >hsa-miR-3655 MIMAT0018075 Homo sapiens miR-3655
gcuugucgcugcgguguugcu

SEQ ID NO: 749 - RNA, 17 nt, Artificial sequence
  >hsa-miR-3656 MIMAT0018076 Homo sapiens miR-3656
ggcgggugcgggggugg

SEQ ID NO: 750 - RNA, 21 nt, Artificial sequence
  >hsa-miR-3657 MIMAT0018077 Homo sapiens miR-3657
ugugucccauuauuggugauu

SEQ ID NO: 751 - RNA, 22 nt, Artificial sequence
  >hsa-miR-3658 MIMAT0018078 Homo sapiens miR-3658
uuuaagaaaacaccauggagau

SEQ ID NO: 752 - RNA, 21 nt, Artificial sequence
  >hsa-miR-3659 MIMAT0018080 Homo sapiens miR-3659
ugaguguugucuacgagggca

SEQ ID NO: 753 - RNA, 22 nt, Artificial sequence
  >hsa-miR-365a-3p MIMAT0000710 Homo sapiens miR-365a-3p
uaaugccccuaaaaauccuuau

SEQ ID NO: 754 - RNA, 23 nt, Artificial sequence
  >hsa-miR-365a-5p MIMAT0009199 Homo sapiens miR-365a-5p
agggacuuuugggggcagaugug

SEQ ID NO: 755 - RNA, 22 nt, Artificial sequence
  >hsa-miR-365b-3p MIMAT0022834 Homo sapiens miR-365b-3p
uaaugccccuaaaaauccuuau

SEQ ID NO: 756 - RNA, 22 nt, Artificial sequence
  >hsa-miR-365b-5p MIMAT0022833 Homo sapiens miR-365b-5p
agggacuuucaggggcagcugu

SEQ ID NO: 757 - RNA, 21 nt, Artificial sequence
  >hsa-miR-3660 MIMAT0018081 Homo sapiens miR-3660
acugacaggagagcauuuuga

SEQ ID NO: 758 - RNA, 22 nt, Artificial sequence
  >hsa-miR-3661 MIMAT0018082 Homo sapiens miR-3661
ugaccugggacucggacagcug

SEQ ID NO: 759 - RNA, 24 nt, Artificial sequence
  >hsa-miR-3662 MIMAT0018083 Homo sapiens miR-3662
gaaaaugaugaguagugacugaug

SEQ ID NO: 760 - RNA, 23 nt, Artificial sequence
  >hsa-miR-3663-3p MIMAT0018085 Homo sapiens miR-3663-3p
ugagcaccacacaggccgggcgc

SEQ ID NO: 761 - RNA, 21 nt, Artificial sequence
  >hsa-miR-3663-5p MIMAT0018084 Homo sapiens miR-3663-5p
gcuggucugcguggugcucgg

SEQ ID NO: 762 - RNA, 22 nt, Artificial sequence
  >hsa-miR-3664-3p MIMAT0019220 Homo sapiens miR-3664-3p
ucucaggaguaaagacagaguu

SEQ ID NO: 763 - RNA, 22 nt, Artificial sequence
  >hsa-miR-3664-5p MIMAT0018086 Homo sapiens miR-3664-5p
aacucugucuucacucaugagu

SEQ ID NO: 764 - RNA, 18 nt, Artificial sequence
  >hsa-miR-3665 MIMAT0018087 Homo sapiens miR-3665
agcaggugcggggcggcg

SEQ ID NO: 765 - RNA, 21 nt, Artificial sequence
  >hsa-miR-3666 MIMAT0018088 Homo sapiens miR-3666
cagugcaaguguagaugccga

SEQ ID NO: 766 - RNA, 22 nt, Artificial sequence
  >hsa-miR-3667-3p MIMAT0018090 Homo sapiens miR-3667-3p
accuuccucuccaugggucuuu

SEQ ID NO: 767 - RNA, 22 nt, Artificial sequence
  >hsa-miR-3667-5p MIMAT0018089 Homo sapiens miR-3667-5p
aaagacccauugaggagaaggu

SEQ ID NO: 768 - RNA, 21 nt, Artificial sequence
  >hsa-miR-3668 MIMAT0018091 Homo sapiens miR-3668
aauguagagauugaucaaaau

SEQ ID NO: 769 - RNA, 22 nt, Artificial sequence
  >hsa-miR-367-3p MIMAT0000719 Homo sapiens miR-367-3p
aauugcacuuuagcaaugguga

SEQ ID NO: 770 - RNA, 22 nt, Artificial sequence
  >hsa-miR-367-5p MIMAT0004686 Homo sapiens miR-367-5p
acuguugcuaauaugcaacucu

SEQ ID NO: 771 - RNA, 24 nt, Artificial sequence
  >hsa-miR-3670 MIMAT0018093 Homo sapiens miR-3670
agagcucacagcuguccuucucua

SEQ ID NO: 772 - RNA, 22 nt, Artificial sequence
  >hsa-miR-3671 MIMAT0018094 Homo sapiens miR-3671
aucaaauaaggacuagucugca

SEQ ID NO: 773 - RNA, 23 nt, Artificial sequence
  >hsa-miR-3672 MIMAT0018095 Homo sapiens miR-3672
augagacucauguaaaacaucuu

SEQ ID NO: 774 - RNA, 22 nt, Artificial sequence
  >hsa-miR-3674 MIMAT0018097 Homo sapiens miR-3674
auuguagaaccuaagauuggcc

SEQ ID NO: 775 - RNA, 22 nt, Artificial sequence
  >hsa-miR-3675-3p MIMAT0018099 Homo sapiens miR-3675-3p
caucucuaaggaacucccccaa

SEQ ID NO: 776 - RNA, 23 nt, Artificial sequence
  >hsa-miR-3675-5p MIMAT0018098 Homo sapiens miR-3675-5p
uauggggcuucuguagagauuuc

SEQ ID NO: 777 - RNA, 22 nt, Artificial sequence
  >hsa-miR-3677-3p MIMAT0018101 Homo sapiens miR-3677-3p
cucgugggcucuggccacggcc

SEQ ID NO: 778 - RNA, 22 nt, Artificial sequence
  >hsa-miR-3677-5p MIMAT0019221 Homo sapiens miR-3677-5p
caguggccagagcccugcagug

SEQ ID NO: 779 - RNA, 22 nt, Artificial sequence
  >hsa-miR-3678-3p MIMAT0018103 Homo sapiens miR-3678-3p
cugcagaguuuguacggaccgg

SEQ ID NO: 780 - RNA, 20 nt, Artificial sequence
  >hsa-miR-3678-5p MIMAT0018102 Homo sapiens miR-3678-5p
uccguacaaacucugcugug

SEQ ID NO: 781 - RNA, 22 nt, Artificial sequence
  >hsa-miR-3679-3p MIMAT0018105 Homo sapiens miR-3679-3p
cuuccccccaguaaucuucauc

SEQ ID NO: 782 - RNA, 23 nt, Artificial sequence
  >hsa-miR-3679-5p MIMAT0018104 Homo sapiens miR-3679-5p
ugaggauauggcagggaagggga

SEQ ID NO: 783 - RNA, 23 nt, Artificial sequence
  >hsa-miR-3680-3p MIMAT0018107 Homo sapiens miR-3680-3p
uuuugcaugacccugggaguagg

SEQ ID NO: 784 - RNA, 22 nt, Artificial sequence
  >hsa-miR-3680-5p MIMAT0018106 Homo sapiens miR-3680-5p
gacucacucacaggauugugca

SEQ ID NO: 785 - RNA, 22 nt, Artificial sequence
  >hsa-miR-3681-3p MIMAT0018109 Homo sapiens miR-3681-3p
acacagugcuucauccacuacu

SEQ ID NO: 786 - RNA, 22 nt, Artificial sequence
  >hsa-miR-3681-5p MIMAT0018108 Homo sapiens miR-3681-5p
uaguggaugaugcacucugugc

SEQ ID NO: 787 - RNA, 21 nt, Artificial sequence
  >hsa-miR-3682-3p MIMAT0018110 Homo sapiens miR-3682-3p
ugaugauacagguggagguag

SEQ ID NO: 788 - RNA, 22 nt, Artificial sequence
  >hsa-miR-3682-5p MIMAT0019222 Homo sapiens miR-3682-5p
cuacuucuaccuguguuaucau

SEQ ID NO: 789 - RNA, 22 nt, Artificial sequence
  >hsa-miR-3683 MIMAT0018111 Homo sapiens miR-3683
ugcgacauuggaaguaguauca

SEQ ID NO: 790 - RNA, 21 nt, Artificial sequence
  >hsa-miR-3684 MIMAT0018112 Homo sapiens miR-3684
uuagaccuaguacacguccuu

SEQ ID NO: 791 - RNA, 22 nt, Artificial sequence
  >hsa-miR-3685 MIMAT0018113 Homo sapiens miR-3685
uuuccuacccuaccugaagacu

SEQ ID NO: 792 - RNA, 22 nt, Artificial sequence
  >hsa-miR-3686 MIMAT0018114 Homo sapiens miR-3686
aucuguaagagaaaguaaauga

SEQ ID NO: 793 - RNA, 24 nt, Artificial sequence
  >hsa-miR-3687 MIMAT0018115 Homo sapiens miR-3687
cccggacaggcguucgugcgacgu

SEQ ID NO: 794 - RNA, 22 nt, Artificial sequence
  >hsa-miR-3688-3p MIMAT0018116 Homo sapiens miR-3688-3p
uauggaaagacuuugccacucu

SEQ ID NO: 795 - RNA, 21 nt, Artificial sequence
  >hsa-miR-3688-5p MIMAT0019223 Homo sapiens miR-3688-5p
aguggcaaagucuuuccauau

SEQ ID NO: 796 - RNA, 22 nt, Artificial sequence
  >hsa-miR-3689a-3p MIMAT0018118 Homo sapiens miR-3689a-3p
cugggaggugugauaucguggu

SEQ ID NO: 797 - RNA, 22 nt, Artificial sequence
  >hsa-miR-3689a-5p MIMAT0018117 Homo sapiens miR-3689a-5p
ugugauaucaugguuccuggga

SEQ ID NO: 798 - RNA, 22 nt, Artificial sequence
  >hsa-miR-3689b-3p MIMAT0018181 Homo sapiens miR-3689b-3p
cugggaggugugauauuguggu

SEQ ID NO: 799 - RNA, 22 nt, Artificial sequence
  >hsa-miR-3689b-5p MIMAT0018180 Homo sapiens miR-3689b-5p
ugugauaucaugguuccuggga

SEQ ID NO: 800 - RNA, 22 nt, Artificial sequence
  >hsa-miR-3689c MIMAT0019007 Homo sapiens miR-3689c
cugggaggugugauauuguggu

SEQ ID NO: 801 - RNA, 22 nt, Artificial sequence
  >hsa-miR-3689d MIMAT0019008 Homo sapiens miR-3689d
gggaggugugaucucacacucg

SEQ ID NO: 802 - RNA, 22 nt, Artificial sequence
  >hsa-miR-3689e MIMAT0019009 Homo sapiens miR-3689e
ugugauaucaugguuccuggga

SEQ ID NO: 803 - RNA, 22 nt, Artificial sequence
  >hsa-miR-3689f MIMAT0019010 Homo sapiens miR-3689f
ugugauaucgugcuuccuggga

SEQ ID NO: 804 - RNA, 21 nt, Artificial sequence
  >hsa-miR-369-3p MIMAT0000721 Homo sapiens miR-369-3p
aauaauacaugguugaucuuu

SEQ ID NO: 805 - RNA, 22 nt, Artificial sequence
  >hsa-miR-369-5p MIMAT0001621 Homo sapiens miR-369-5p
agaucgaccguguuauauucgc

SEQ ID NO: 806 - RNA, 23 nt, Artificial sequence
  >hsa-miR-3690 MIMAT0018119 Homo sapiens miR-3690
accuggacccagcguagacaaag

SEQ ID NO: 807 - RNA, 22 nt, Artificial sequence
  >hsa-miR-3691-3p MIMAT0019224 Homo sapiens miR-3691-3p
accaagucugcgucauccucuc

SEQ ID NO: 808 - RNA, 23 nt, Artificial sequence
  >hsa-miR-3691-5p MIMAT0018120 Homo sapiens miR-3691-5p
aguggaugauggagacucgguac

SEQ ID NO: 809 - RNA, 24 nt, Artificial sequence
  >hsa-miR-3692-3p MIMAT0018122 Homo sapiens miR-3692-3p
guuccacacugacacugcagaagu

SEQ ID NO: 810 - RNA, 24 nt, Artificial sequence
  >hsa-miR-3692-5p MIMAT0018121 Homo sapiens miR-3692-5p
ccugcuggucaggaguggauacug

SEQ ID NO: 811 - RNA, 22 nt, Artificial sequence
  >hsa-miR-370-3p MIMAT0000722 Homo sapiens miR-370-3p
gccugcugggguggaaccuggu

SEQ ID NO: 812 - RNA, 22 nt, Artificial sequence
  >hsa-miR-370-5p MIMAT0026483 Homo sapiens miR-370-5p
caggucacgucucugcaguuac

SEQ ID NO: 813 - RNA, 20 nt, Artificial sequence
  >hsa-miR-3713 MIMAT0018164 Homo sapiens miR-3713
gguauccguuuggggauggu

SEQ ID NO: 814 - RNA, 22 nt, Artificial sequence
  >hsa-miR-3714 MIMAT0018165 Homo sapiens miR-3714
gaaggcagcagugcuccccugu

SEQ ID NO: 815 - RNA, 23 nt, Artificial sequence
  >hsa-miR-371a-3p MIMAT0000723 Homo sapiens miR-371a-3p
aagugccgccaucuuuugagugu

SEQ ID NO: 816 - RNA, 20 nt, Artificial sequence
  >hsa-miR-371a-5p MIMAT0004687 Homo sapiens miR-371a-5p
acucaaacugugggggcacu

SEQ ID NO: 817 - RNA, 23 nt, Artificial sequence
  >hsa-miR-371b-3p MIMAT0019893 Homo sapiens miR-371b-3p
aagugcccccacaguuugagugc

SEQ ID NO: 818 - RNA, 22 nt, Artificial sequence
  >hsa-miR-371b-5p MIMAT0019892 Homo sapiens miR-371b-5p
acucaaaagauggcggcacuuu

SEQ ID NO: 819 - RNA, 23 nt, Artificial sequence
  >hsa-miR-372-3p MIMAT0000724 Homo sapiens miR-372-3p
aaagugcugcgacauuugagcgu

SEQ ID NO: 820 - RNA, 23 nt, Artificial sequence
  >hsa-miR-372-5p MIMAT0026484 Homo sapiens miR-372-5p
ccucaaauguggagcacuauucu

SEQ ID NO: 821 - RNA, 23 nt, Artificial sequence
  >hsa-miR-373-3p MIMAT0000726 Homo sapiens miR-373-3p
gaagugcuucgauuuuggggugu

SEQ ID NO: 822 - RNA, 22 nt, Artificial sequence
  >hsa-miR-373-5p MIMAT0000725 Homo sapiens miR-373-5p
acucaaaaugggggcgcuuucc

SEQ ID NO: 823 - RNA, 22 nt, Artificial sequence
  >hsa-miR-374a-3p MIMAT0004688 Homo sapiens miR-374a-3p
cuuaucagauuguauuguaauu

SEQ ID NO: 824 - RNA, 22 nt, Artificial sequence
  >hsa-miR-374a-5p MIMAT0000727 Homo sapiens miR-374a-5p
uuauaauacaaccugauaagug

SEQ ID NO: 825 - RNA, 22 nt, Artificial sequence
  >hsa-miR-374b-3p MIMAT0004956 Homo sapiens miR-374b-3p
cuuagcagguuguauuaucauu

SEQ ID NO: 826 - RNA, 22 nt, Artificial sequence
  >hsa-miR-374b-5p MIMAT0004955 Homo sapiens miR-374b-5p
auauaauacaaccugcuaagug

SEQ ID NO: 827 - RNA, 22 nt, Artificial sequence
  >hsa-miR-374c-3p MIMAT0022735 Homo sapiens miR-374c-3p
cacuuagcagguuguauuauau

SEQ ID NO: 828 - RNA, 22 nt, Artificial sequence
  >hsa-miR-374c-5p MIMAT0018443 Homo sapiens miR-374c-5p
auaauacaaccugcuaagugcu

SEQ ID NO: 829 - RNA, 22 nt, Artificial sequence
  >hsa-miR-375 MIMAT0000728 Homo sapiens miR-375
uuuguucguucggcucgcguga

SEQ ID NO: 830 - RNA, 21 nt, Artificial sequence
  >hsa-miR-376a-2-5p MIMAT0022928 Homo sapiens miR-376a-2-5p
gguagauuuuccuucuauggu

SEQ ID NO: 831 - RNA, 21 nt, Artificial sequence
  >hsa-miR-376a-3p MIMAT0000729 Homo sapiens miR-376a-3p
aucauagaggaaaauccacgu

SEQ ID NO: 832 - RNA, 22 nt, Artificial sequence
  >hsa-miR-376a-5p MIMAT0003386 Homo sapiens miR-376a-5p
guagauucuccuucuaugagua

SEQ ID NO: 833 - RNA, 22 nt, Artificial sequence
  >hsa-miR-376b-3p MIMAT0002172 Homo sapiens miR-376b-3p
aucauagaggaaaauccauguu

SEQ ID NO: 834 - RNA, 22 nt, Artificial sequence
  >hsa-miR-376b-5p MIMAT0022923 Homo sapiens miR-376b-5p
cguggauauuccuucuauguuu

SEQ ID NO: 835 - RNA, 21 nt, Artificial sequence
  >hsa-miR-376c-3p MIMAT0000720 Homo sapiens miR-376c-3p
aacauagaggaaauuccacgu

SEQ ID NO: 836 - RNA, 21 nt, Artificial sequence
  >hsa-miR-376c-5p MIMAT0022861 Homo sapiens miR-376c-5p
gguggauauuccuucuauguu

SEQ ID NO: 837 - RNA, 22 nt, Artificial sequence
  >hsa-miR-377-3p MIMAT0000730 Homo sapiens miR-377-3p
aucacacaaaggcaacuuuugu

SEQ ID NO: 838 - RNA, 22 nt, Artificial sequence
  >hsa-miR-377-5p MIMAT0004689 Homo sapiens miR-377-5p
agagguugcccuuggugaauuc

SEQ ID NO: 839 - RNA, 22 nt, Artificial sequence
  >hsa-miR-378a-3p MIMAT0000732 Homo sapiens miR-378a-3p
acuggacuuggagucagaaggc

SEQ ID NO: 840 - RNA, 22 nt, Artificial sequence
  >hsa-miR-378a-5p MIMAT0000731 Homo sapiens miR-378a-5p
cuccugacuccagguccugugu

SEQ ID NO: 841 - RNA, 19 nt, Artificial sequence
  >hsa-miR-378b MIMAT0014999 Homo sapiens miR-378b
acuggacuuggaggcagaa

SEQ ID NO: 842 - RNA, 25 nt, Artificial sequence
  >hsa-miR-378c MIMAT0016847 Homo sapiens miR-378c
acuggacuuggagucagaagagugg

SEQ ID NO: 843 - RNA, 20 nt, Artificial sequence
  >hsa-miR-378d MIMAT0018926 Homo sapiens miR-378d
acuggacuuggagucagaaa

SEQ ID NO: 844 - RNA, 19 nt, Artificial sequence
  >hsa-miR-378e MIMAT0018927 Homo sapiens miR-378e
acuggacuuggagucagga

SEQ ID NO: 845 - RNA, 20 nt, Artificial sequence
  >hsa-miR-378f MIMAT0018932 Homo sapiens miR-378f
acuggacuuggagccagaag

SEQ ID NO: 846 - RNA, 20 nt, Artificial sequence
  >hsa-miR-378g MIMAT0018937 Homo sapiens miR-378g
acugggcuuggagucagaag

SEQ ID NO: 847 - RNA, 21 nt, Artificial sequence
  >hsa-miR-378h MIMAT0018984 Homo sapiens miR-378h
acuggacuuggugucagaugg

SEQ ID NO: 848 - RNA, 21 nt, Artificial sequence
  >hsa-miR-378i MIMAT0019074 Homo sapiens miR-378i
acuggacuaggagucagaagg

SEQ ID NO: 849 - RNA, 19 nt, Artificial sequence
  >hsa-miR-378j MIMAT0024612 Homo sapiens miR-378j
acuggauuuggagccagaa

SEQ ID NO: 850 - RNA, 22 nt, Artificial sequence
  >hsa-miR-379-3p MIMAT0004690 Homo sapiens miR-379-3p
uauguaacaugguccacuaacu

SEQ ID NO: 851 - RNA, 21 nt, Artificial sequence
  >hsa-miR-379-5p MIMAT0000733 Homo sapiens miR-379-5p
ugguagacuauggaacguagg

SEQ ID NO: 852 - RNA, 22 nt, Artificial sequence
  >hsa-miR-380-3p MIMAT0000735 Homo sapiens miR-380-3p
uauguaauaugguccacaucuu

SEQ ID NO: 853 - RNA, 22 nt, Artificial sequence
  >hsa-miR-380-5p MIMAT0000734 Homo sapiens miR-380-5p
ugguugaccauagaacaugcgc

SEQ ID NO: 854 - RNA, 22 nt, Artificial sequence
  >hsa-miR-381-3p MIMAT0000736 Homo sapiens miR-381-3p
uauacaagggcaagcucucugu

SEQ ID NO: 855 - RNA, 22 nt, Artificial sequence
  >hsa-miR-381-5p MIMAT0022862 Homo sapiens miR-381-5p
agcgagguugcccuuuguauau

SEQ ID NO: 856 - RNA, 21 nt, Artificial sequence
  >hsa-miR-382-3p MIMAT0022697 Homo sapiens miR-382-3p
aaucauucacggacaacacuu

SEQ ID NO: 857 - RNA, 22 nt, Artificial sequence
  >hsa-miR-382-5p MIMAT0000737 Homo sapiens miR-382-5p
gaaguuguucgugguggauucg

SEQ ID NO: 858 - RNA, 19 nt, Artificial sequence
  >hsa-miR-383-3p MIMAT0026485 Homo sapiens miR-383-3p
acagcacugccuggucaga

SEQ ID NO: 859 - RNA, 22 nt, Artificial sequence
  >hsa-miR-383-5p MIMAT0000738 Homo sapiens miR-383-5p
agaucagaaggugauuguggcu

SEQ ID NO: 860 - RNA, 20 nt, Artificial sequence
  >hsa-miR-384 MIMAT0001075 Homo sapiens miR-384
auuccuagaaauuguucaua

SEQ ID NO: 861 - RNA, 22 nt, Artificial sequence
  >hsa-miR-3907 MIMAT0018179 Homo sapiens miR-3907
aggugcuccaggcuggcucaca

SEQ ID NO: 862 - RNA, 22 nt, Artificial sequence
  >hsa-miR-3908 MIMAT0018182 Homo sapiens miR-3908
gagcaauguagguagacuguuu

SEQ ID NO: 863 - RNA, 22 nt, Artificial sequence
  >hsa-miR-3909 MIMAT0018183 Homo sapiens miR-3909
uguccucuagggccugcagucu

SEQ ID NO: 864 - RNA, 20 nt, Artificial sequence
  >hsa-miR-3910 MIMAT0018184 Homo sapiens miR-3910
aaaggcauaaaaccaagaca

SEQ ID NO: 865 - RNA, 22 nt, Artificial sequence
  >hsa-miR-3911 MIMAT0018185 Homo sapiens miR-3911
uguguggauccuggaggaggca

SEQ ID NO: 866 - RNA, 21 nt, Artificial sequence
  >hsa-miR-3912-3p MIMAT0018186 Homo sapiens miR-3912-3p
uaacgcauaauauggacaugu

SEQ ID NO: 867 - RNA, 21 nt, Artificial sequence
  >hsa-miR-3912-5p MIMAT0027036 Homo sapiens miR-3912-5p
auguccauauuauggguuagu

SEQ ID NO: 868 - RNA, 22 nt, Artificial sequence
  >hsa-miR-3913-3p MIMAT0019225 Homo sapiens miR-3913-3p
agacaucaagaucagucccaaa

SEQ ID NO: 869 - RNA, 22 nt, Artificial sequence
  >hsa-miR-3913-5p MIMAT0018187 Homo sapiens miR-3913-5p
uuugggacugaucuugaugucu

SEQ ID NO: 870 - RNA, 22 nt, Artificial sequence
  >hsa-miR-3914 MIMAT0018188 Homo sapiens miR-3914
aaggaaccagaaaaugagaagu

SEQ ID NO: 871 - RNA, 22 nt, Artificial sequence
  >hsa-miR-3915 MIMAT0018189 Homo sapiens miR-3915
uugaggaaaagauggucuuauu

SEQ ID NO: 872 - RNA, 26 nt, Artificial sequence
  >hsa-miR-3916 MIMAT0018190 Homo sapiens miR-3916
aagaggaagaaauggcugguucucag

SEQ ID NO: 873 - RNA, 20 nt, Artificial sequence
  >hsa-miR-3917 MIMAT0018191 Homo sapiens miR-3917
gcucggacugagcagguggg

SEQ ID NO: 874 - RNA, 21 nt, Artificial sequence
  >hsa-miR-3918 MIMAT0018192 Homo sapiens miR-3918
acagggccgcagauggagacu

SEQ ID NO: 875 - RNA, 21 nt, Artificial sequence
  >hsa-miR-3919 MIMAT0018193 Homo sapiens miR-3919
gcagagaacaaaggacucagu

SEQ ID NO: 876 - RNA, 22 nt, Artificial sequence
  >hsa-miR-3920 MIMAT0018195 Homo sapiens miR-3920
acugauuaucuuaacucucuga

SEQ ID NO: 877 - RNA, 23 nt, Artificial sequence
  >hsa-miR-3921 MIMAT0018196 Homo sapiens miR-3921
ucucugaguaccauaugccuugu

SEQ ID NO: 878 - RNA, 22 nt, Artificial sequence
  >hsa-miR-3922-3p MIMAT0018197 Homo sapiens miR-3922-3p
ucuggccuugacuugacucuuu

SEQ ID NO: 879 - RNA, 23 nt, Artificial sequence
  >hsa-miR-3922-5p MIMAT0019227 Homo sapiens miR-3922-5p
ucaaggccagaggucccacagca

SEQ ID NO: 880 - RNA, 22 nt, Artificial sequence
  >hsa-miR-3923 MIMAT0018198 Homo sapiens miR-3923
aacuaguaauguuggauuaggg

SEQ ID NO: 881 - RNA, 22 nt, Artificial sequence
  >hsa-miR-3924 MIMAT0018199 Homo sapiens miR-3924
auauguauaugugacugcuacu

SEQ ID NO: 882 - RNA, 21 nt, Artificial sequence
  >hsa-miR-3925-3p MIMAT0019228 Homo sapiens miR-3925-3p
acuccaguuuuaguucucuug

SEQ ID NO: 883 - RNA, 22 nt, Artificial sequence
  >hsa-miR-3925-5p MIMAT0018200 Homo sapiens miR-3925-5p
aagagaacugaaaguggagccu

SEQ ID NO: 884 - RNA, 21 nt, Artificial sequence
  >hsa-miR-3926 MIMAT0018201 Homo sapiens miR-3926
uggccaaaaagcaggcagaga

SEQ ID NO: 885 - RNA, 22 nt, Artificial sequence
  >hsa-miR-3927-3p MIMAT0018202 Homo sapiens miR-3927-3p
cagguagauauuugauaggcau

SEQ ID NO: 886 - RNA, 21 nt, Artificial sequence
  >hsa-miR-3927-5p MIMAT0022970 Homo sapiens miR-3927-5p
gccuaucacauaucugccugu

SEQ ID NO: 887 - RNA, 22 nt, Artificial sequence
  >hsa-miR-3928-3p MIMAT0018205 Homo sapiens miR-3928-3p
ggaggaaccuuggagcuucggc

SEQ ID NO: 888 - RNA, 23 nt, Artificial sequence
  >hsa-miR-3928-5p MIMAT0027037 Homo sapiens miR-3928-5p
ugaagcucuaagguuccgccugc

SEQ ID NO: 889 - RNA, 23 nt, Artificial sequence
  >hsa-miR-3929 MIMAT0018206 Homo sapiens miR-3929
gaggcugaugugaguagaccacu

SEQ ID NO: 890 - RNA, 22 nt, Artificial sequence
  >hsa-miR-3934-3p MIMAT0022975 Homo sapiens miR-3934-3p
ugcucagguugcacagcuggga

SEQ ID NO: 891 - RNA, 22 nt, Artificial sequence
  >hsa-miR-3934-5p MIMAT0018349 Homo sapiens miR-3934-5p
ucagguguggaaacugaggcag

SEQ ID NO: 892 - RNA, 22 nt, Artificial sequence
  >hsa-miR-3935 MIMAT0018350 Homo sapiens miR-3935
uguagauacgagcaccagccac

SEQ ID NO: 893 - RNA, 22 nt, Artificial sequence
  >hsa-miR-3936 MIMAT0018351 Homo sapiens miR-3936
uaagggguguauggcagaugca

SEQ ID NO: 894 - RNA, 23 nt, Artificial sequence
  >hsa-miR-3937 MIMAT0018352 Homo sapiens miR-3937
acaggcggcuguagcaauggggg

SEQ ID NO: 895 - RNA, 22 nt, Artificial sequence
  >hsa-miR-3938 MIMAT0018353 Homo sapiens miR-3938
aauucccuuguagauaacccgg

SEQ ID NO: 896 - RNA, 22 nt, Artificial sequence
  >hsa-miR-3939 MIMAT0018355 Homo sapiens miR-3939
uacgcgcagaccacaggauguc

SEQ ID NO: 897 - RNA, 22 nt, Artificial sequence
  >hsa-miR-3940-3p MIMAT0018356 Homo sapiens miR-3940-3p
cagcccggaucccagcccacuu

SEQ ID NO: 898 - RNA, 20 nt, Artificial sequence
  >hsa-miR-3940-5p MIMAT0019229 Homo sapiens miR-3940-5p
guggguuggggcgggcucug

SEQ ID NO: 899 - RNA, 22 nt, Artificial sequence
  >hsa-miR-3941 MIMAT0018357 Homo sapiens miR-3941
uuacacacaacugaggaucaua

SEQ ID NO: 900 - RNA, 21 nt, Artificial sequence
  >hsa-miR-3942-3p MIMAT0019230 Homo sapiens miR-3942-3p
uuucagauaacaguauuacau

SEQ ID NO: 901 - RNA, 22 nt, Artificial sequence
  >hsa-miR-3942-5p MIMAT0018358 Homo sapiens miR-3942-5p
aagcaauacuguuaccugaaau

SEQ ID NO: 902 - RNA, 23 nt, Artificial sequence
  >hsa-miR-3943 MIMAT0018359 Homo sapiens miR-3943
uagcccccaggcuucacuuggcg

SEQ ID NO: 903 - RNA, 23 nt, Artificial sequence
  >hsa-miR-3944-3p MIMAT0018360 Homo sapiens miR-3944-3p
uucgggcuggccugcugcuccgg

SEQ ID NO: 904 - RNA, 21 nt, Artificial sequence
  >hsa-miR-3944-5p MIMAT0019231 Homo sapiens miR-3944-5p
ugugcagcaggccaaccgaga

SEQ ID NO: 905 - RNA, 23 nt, Artificial sequence
  >hsa-miR-3945 MIMAT0018361 Homo sapiens miR-3945
agggcauaggagaggguugauau

SEQ ID NO: 906 - RNA, 20 nt, Artificial sequence
  >hsa-miR-3960 MIMAT0019337 Homo sapiens miR-3960
ggcggcggcggaggcggggg

SEQ ID NO: 907 - RNA, 22 nt, Artificial sequence
  >hsa-miR-3972 MIMAT0019357 Homo sapiens miR-3972
cugccagccccguuccagggca

SEQ ID NO: 908 - RNA, 23 nt, Artificial sequence
  >hsa-miR-3973 MIMAT0019358 Homo sapiens miR-3973
acaaaguacagcauuagccuuag

SEQ ID NO: 909 - RNA, 23 nt, Artificial sequence
  >hsa-miR-3974 MIMAT0019359 Homo sapiens miR-3974
aaaggucauuguaagguuaaugc

SEQ ID NO: 910 - RNA, 22 nt, Artificial sequence
  >hsa-miR-3975 MIMAT0019360 Homo sapiens miR-3975
ugaggcuaaugcacuacuucac

SEQ ID NO: 911 - RNA, 24 nt, Artificial sequence
  >hsa-miR-3976 MIMAT0019361 Homo sapiens miR-3976
uauagagagcaggaagauuaaugu

SEQ ID NO: 912 - RNA, 23 nt, Artificial sequence
  >hsa-miR-3977 MIMAT0019362 Homo sapiens miR-3977
gugcuucaucguaauuaaccuua

SEQ ID NO: 913 - RNA, 24 nt, Artificial sequence
  >hsa-miR-3978 MIMAT0019363 Homo sapiens miR-3978
guggaaagcaugcauccagggugu

SEQ ID NO: 914 - RNA, 22 nt, Artificial sequence
  >hsa-miR-409-3p MIMAT0001639 Homo sapiens miR-409-3p
gaauguugcucggugaaccccu

SEQ ID NO: 915 - RNA, 23 nt, Artificial sequence
  >hsa-miR-409-5p MIMAT0001638 Homo sapiens miR-409-5p
agguuacccgagcaacuuugcau

SEQ ID NO: 916 - RNA, 21 nt, Artificial sequence
  >hsa-miR-410-3p MIMAT0002171 Homo sapiens miR-410-3p
aauauaacacagauggccugu

SEQ ID NO: 917 - RNA, 21 nt, Artificial sequence
  >hsa-miR-410-5p MIMAT0026558 Homo sapiens miR-410-5p
agguugucugugaugaguucg

SEQ ID NO: 918 - RNA, 22 nt, Artificial sequence
  >hsa-miR-411-3p MIMAT0004813 Homo sapiens miR-411-3p
uauguaacacgguccacuaacc

SEQ ID NO: 919 - RNA, 21 nt, Artificial sequence
  >hsa-miR-411-5p MIMAT0003329 Homo sapiens miR-411-5p
uaguagaccguauagcguacg

SEQ ID NO: 920 - RNA, 23 nt, Artificial sequence
  >hsa-miR-412-3p MIMAT0002170 Homo sapiens miR-412-3p
acuucaccugguccacuagccgu

SEQ ID NO: 921 - RNA, 23 nt, Artificial sequence
  >hsa-miR-412-5p MIMAT0026557 Homo sapiens miR-412-5p
uggucgaccaguuggaaaguaau

SEQ ID NO: 922 - RNA, 23 nt, Artificial sequence
  >hsa-miR-421 MIMAT0003339 Homo sapiens miR-421
aucaacagacauuaauugggcgc

SEQ ID NO: 923 - RNA, 22 nt, Artificial sequence
  >hsa-miR-422a MIMAT0001339 Homo sapiens miR-422a
acuggacuuagggucagaaggc

SEQ ID NO: 924 - RNA, 23 nt, Artificial sequence
  >hsa-miR-423-3p MIMAT0001340 Homo sapiens miR-423-3p
agcucggucugaggccccucagu

SEQ ID NO: 925 - RNA, 23 nt, Artificial sequence
  >hsa-miR-423-5p MIMAT0004748 Homo sapiens miR-423-5p
ugaggggcagagagcgagacuuu

SEQ ID NO: 926 - RNA, 21 nt, Artificial sequence
  >hsa-miR-424-3p MIMAT0004749 Homo sapiens miR-424-3p
caaaacgugaggcgcugcuau

SEQ ID NO: 927 - RNA, 22 nt, Artificial sequence
  >hsa-miR-424-5p MIMAT0001341 Homo sapiens miR-424-5p
cagcagcaauucauguuuugaa

SEQ ID NO: 928 - RNA, 22 nt, Artificial sequence
  >hsa-miR-425-3p MIMAT0001343 Homo sapiens miR-425-3p
aucgggaaugucguguccgccc

SEQ ID NO: 929 - RNA, 23 nt, Artificial sequence
  >hsa-miR-425-5p MIMAT0003393 Homo sapiens miR-425-5p
aaugacacgaucacucccguuga

SEQ ID NO: 930 - RNA, 17 nt, Artificial sequence
  >hsa-miR-4251 MIMAT0016883 Homo sapiens miR-4251
ccugagaaaagggccaa

SEQ ID NO: 931 - RNA, 19 nt, Artificial sequence
  >hsa-miR-4252 MIMAT0016886 Homo sapiens miR-4252
ggccacugagucagcacca

SEQ ID NO: 932 - RNA, 18 nt, Artificial sequence
  >hsa-miR-4253 MIMAT0016882 Homo sapiens miR-4253
agggcauguccagggggu

SEQ ID NO: 933 - RNA, 23 nt, Artificial sequence
  >hsa-miR-4254 MIMAT0016884 Homo sapiens miR-4254
gccuggagcuacuccaccaucuc

SEQ ID NO: 934 - RNA, 17 nt, Artificial sequence
  >hsa-miR-4255 MIMAT0016885 Homo sapiens miR-4255
caguguucagagaugga

SEQ ID NO: 935 - RNA, 18 nt, Artificial sequence
  >hsa-miR-4256 MIMAT0016877 Homo sapiens miR-4256
aucugaccugaugaaggu

SEQ ID NO: 936 - RNA, 18 nt, Artificial sequence
  >hsa-miR-4257 MIMAT0016878 Homo sapiens miR-4257
ccagagguggggacugag

SEQ ID NO: 937 - RNA, 17 nt, Artificial sequence
  >hsa-miR-4258 MIMAT0016879 Homo sapiens miR-4258
ccccgccaccgccuugg

SEQ ID NO: 938 - RNA, 22 nt, Artificial sequence
  >hsa-miR-4259 MIMAT0016880 Homo sapiens miR-4259
caguugggucuaggggucagga

SEQ ID NO: 939 - RNA, 19 nt, Artificial sequence
  >hsa-miR-4260 MIMAT0016881 Homo sapiens miR-4260
cuuggggcauggaguccca

SEQ ID NO: 940 - RNA, 16 nt, Artificial sequence
  >hsa-miR-4261 MIMAT0016890 Homo sapiens miR-4261
aggaaacagggaccca

SEQ ID NO: 941 - RNA, 17 nt, Artificial sequence
  >hsa-miR-4262 MIMAT0016894 Homo sapiens miR-4262
gacauucagacuaccug

SEQ ID NO: 942 - RNA, 18 nt, Artificial sequence
  >hsa-miR-4263 MIMAT0016898 Homo sapiens miR-4263
auucuaagugccuuggcc

SEQ ID NO: 943 - RNA, 17 nt, Artificial sequence
  >hsa-miR-4264 MIMAT0016899 Homo sapiens miR-4264
acucagucauggucauu

SEQ ID NO: 944 - RNA, 19 nt, Artificial sequence
  >hsa-miR-4265 MIMAT0016891 Homo sapiens miR-4265
cugugggcucagcucuggg

SEQ ID NO: 945 - RNA, 16 nt, Artificial sequence
  >hsa-miR-4266 MIMAT0016892 Homo sapiens miR-4266
cuaggaggccuuggcc

SEQ ID NO: 946 - RNA, 16 nt, Artificial sequence
  >hsa-miR-4267 MIMAT0016893 Homo sapiens miR-4267
uccagcucgguggcac

SEQ ID NO: 947 - RNA, 21 nt, Artificial sequence
  >hsa-miR-4268 MIMAT0016896 Homo sapiens miR-4268
ggcuccuccucucaggaugug

SEQ ID NO: 948 - RNA, 21 nt, Artificial sequence
  >hsa-miR-4269 MIMAT0016897 Homo sapiens miR-4269
gcaggcacagacagcccuggc

SEQ ID NO: 949 - RNA, 20 nt, Artificial sequence
  >hsa-miR-4270 MIMAT0016900 Homo sapiens miR-4270
ucagggagucaggggagggc

SEQ ID NO: 950 - RNA, 19 nt, Artificial sequence
  >hsa-miR-4271 MIMAT0016901 Homo sapiens miR-4271
gggggaagaaaaggugggg

SEQ ID NO: 951 - RNA, 18 nt, Artificial sequence
  >hsa-miR-4272 MIMAT0016902 Homo sapiens miR-4272
cauucaacuagugauugu

SEQ ID NO: 952 - RNA, 18 nt, Artificial sequence
  >hsa-miR-4273 MIMAT0016903 Homo sapiens miR-4273
guguucucugauggacag

SEQ ID NO: 953 - RNA, 18 nt, Artificial sequence
  >hsa-miR-4274 MIMAT0016906 Homo sapiens miR-4274
cagcagucccucccccug

SEQ ID NO: 954 - RNA, 17 nt, Artificial sequence
  >hsa-miR-4275 MIMAT0016905 Homo sapiens miR-4275
ccaauuaccacuucuuu

SEQ ID NO: 955 - RNA, 17 nt, Artificial sequence
  >hsa-miR-4276 MIMAT0016904 Homo sapiens miR-4276
cucagugacucaugugc

SEQ ID NO: 956 - RNA, 21 nt, Artificial sequence
  >hsa-miR-4277 MIMAT0016908 Homo sapiens miR-4277
gcaguucugagcacaguacac

SEQ ID NO: 957 - RNA, 18 nt, Artificial sequence
  >hsa-miR-4278 MIMAT0016910 Homo sapiens miR-4278
cuaggggguuugcccuug

SEQ ID NO: 958 - RNA, 16 nt, Artificial sequence
  >hsa-miR-4279 MIMAT0016909 Homo sapiens miR-4279
cucuccucccggcuuc

SEQ ID NO: 959 - RNA, 21 nt, Artificial sequence
  >hsa-miR-4280 MIMAT0016911 Homo sapiens miR-4280
gaguguaguucugagcagagc

SEQ ID NO: 960 - RNA, 18 nt, Artificial sequence
  >hsa-miR-4281 MIMAT0016907 Homo sapiens miR-4281
gggucccggggagggggg

SEQ ID NO: 961 - RNA, 18 nt, Artificial sequence
  >hsa-miR-4282 MIMAT0016912 Homo sapiens miR-4282
uaaaauuugcauccagga

SEQ ID NO: 962 - RNA, 17 nt, Artificial sequence
  >hsa-miR-4283 MIMAT0016914 Homo sapiens miR-4283
uggggcucagcgaguuu

SEQ ID NO: 963 - RNA, 18 nt, Artificial sequence
  >hsa-miR-4284 MIMAT0016915 Homo sapiens miR-4284
gggcucacaucaccccau

SEQ ID NO: 964 - RNA, 18 nt, Artificial sequence
  >hsa-miR-4285 MIMAT0016913 Homo sapiens miR-4285
gcggcgaguccgacucau

SEQ ID NO: 965 - RNA, 17 nt, Artificial sequence
  >hsa-miR-4286 MIMAT0016916 Homo sapiens miR-4286
accccacuccugguacc

SEQ ID NO: 966 - RNA, 19 nt, Artificial sequence
  >hsa-miR-4287 MIMAT0016917 Homo sapiens miR-4287
ucucccuugagggcacuuu

SEQ ID NO: 967 - RNA, 17 nt, Artificial sequence
  >hsa-miR-4288 MIMAT0016918 Homo sapiens miR-4288
uugucugcugaguuucc

SEQ ID NO: 968 - RNA, 19 nt, Artificial sequence
  >hsa-miR-4289 MIMAT0016920 Homo sapiens miR-4289
gcauugugcagggcuauca

SEQ ID NO: 969 - RNA, 22 nt, Artificial sequence
  >hsa-miR-429 MIMAT0001536 Homo sapiens miR-429
uaauacugucugguaaaaccgu

SEQ ID NO: 970 - RNA, 19 nt, Artificial sequence
  >hsa-miR-4290 MIMAT0016921 Homo sapiens miR-4290
ugcccuccuuucuucccuc

SEQ ID NO: 971 - RNA, 16 nt, Artificial sequence
  >hsa-miR-4291 MIMAT0016922 Homo sapiens miR-4291
uucagcaggaacagcu

SEQ ID NO: 972 - RNA, 18 nt, Artificial sequence
  >hsa-miR-4292 MIMAT0016919 Homo sapiens miR-4292
ccccugggccggccuugg

SEQ ID NO: 973 - RNA, 17 nt, Artificial sequence
  >hsa-miR-4293 MIMAT0016848 Homo sapiens miR-4293
cagccugacaggaacag

SEQ ID NO: 974 - RNA, 17 nt, Artificial sequence
  >hsa-miR-4294 MIMAT0016849 Homo sapiens miR-4294
gggagucuacagcaggg

SEQ ID NO: 975 - RNA, 18 nt, Artificial sequence
  >hsa-miR-4295 MIMAT0016844 Homo sapiens miR-4295
cagugcaauguuuuccuu

SEQ ID NO: 976 - RNA, 17 nt, Artificial sequence
  >hsa-miR-4296 MIMAT0016845 Homo sapiens miR-4296
augugggcucaggcuca

SEQ ID NO: 977 - RNA, 16 nt, Artificial sequence
  >hsa-miR-4297 MIMAT0016846 Homo sapiens miR-4297
ugccuuccugucugug

SEQ ID NO: 978 - RNA, 22 nt, Artificial sequence
  >hsa-miR-4298 MIMAT0016852 Homo sapiens miR-4298
cugggacaggaggaggaggcag

SEQ ID NO: 979 - RNA, 18 nt, Artificial sequence
  >hsa-miR-4299 MIMAT0016851 Homo sapiens miR-4299
gcuggugacaugagaggc

SEQ ID NO: 980 - RNA, 18 nt, Artificial sequence
  >hsa-miR-4300 MIMAT0016853 Homo sapiens miR-4300
ugggagcuggacuacuuc

SEQ ID NO: 981 - RNA, 20 nt, Artificial sequence
  >hsa-miR-4301 MIMAT0016850 Homo sapiens miR-4301
ucccacuacuucacuuguga

SEQ ID NO: 982 - RNA, 18 nt, Artificial sequence
  >hsa-miR-4302 MIMAT0016855 Homo sapiens miR-4302
ccaguguggcucagcgag

SEQ ID NO: 983 - RNA, 17 nt, Artificial sequence
  >hsa-miR-4303 MIMAT0016856 Homo sapiens miR-4303
uucugagcugaggacag

SEQ ID NO: 984 - RNA, 17 nt, Artificial sequence
  >hsa-miR-4304 MIMAT0016854 Homo sapiens miR-4304
ccggcauguccagggca

SEQ ID NO: 985 - RNA, 18 nt, Artificial sequence
  >hsa-miR-4305 MIMAT0016857 Homo sapiens miR-4305
ccuagacaccuccaguuc

SEQ ID NO: 986 - RNA, 17 nt, Artificial sequence
  >hsa-miR-4306 MIMAT0016858 Homo sapiens miR-4306
uggagagaaaggcagua

SEQ ID NO: 987 - RNA, 19 nt, Artificial sequence
  >hsa-miR-4307 MIMAT0016860 Homo sapiens miR-4307
aauguuuuuuccuguuucc

SEQ ID NO: 988 - RNA, 18 nt, Artificial sequence
  >hsa-miR-4308 MIMAT0016861 Homo sapiens miR-4308
ucccuggaguuucuucuu

SEQ ID NO: 989 - RNA, 18 nt, Artificial sequence
  >hsa-miR-4309 MIMAT0016859 Homo sapiens miR-4309
cuggagucuaggauucca

SEQ ID NO: 990 - RNA, 22 nt, Artificial sequence
  >hsa-miR-431-3p MIMAT0004757 Homo sapiens miR-431-3p
caggucgucuugcagggcuucu

SEQ ID NO: 991 - RNA, 21 nt, Artificial sequence
  >hsa-miR-431-5p MIMAT0001625 Homo sapiens miR-431-5p
ugucuugcaggccgucaugca

SEQ ID NO: 992 - RNA, 16 nt, Artificial sequence
  >hsa-miR-4310 MIMAT0016862 Homo sapiens miR-4310
gcagcauucauguccc

SEQ ID NO: 993 - RNA, 18 nt, Artificial sequence
  >hsa-miR-4311 MIMAT0016863 Homo sapiens miR-4311
gaaagagagcugagugug

SEQ ID NO: 994 - RNA, 19 nt, Artificial sequence
  >hsa-miR-4312 MIMAT0016864 Homo sapiens miR-4312
ggccuuguuccugucccca

SEQ ID NO: 995 - RNA, 20 nt, Artificial sequence
  >hsa-miR-4313 MIMAT0016865 Homo sapiens miR-4313
agcccccuggccccaaaccc

SEQ ID NO: 996 - RNA, 18 nt, Artificial sequence
  >hsa-miR-4314 MIMAT0016868 Homo sapiens miR-4314
cucugggaaaugggacag

SEQ ID NO: 997 - RNA, 18 nt, Artificial sequence
  >hsa-miR-4315 MIMAT0016866 Homo sapiens miR-4315
ccgcuuucugagcuggac

SEQ ID NO: 998 - RNA, 17 nt, Artificial sequence
  >hsa-miR-4316 MIMAT0016867 Homo sapiens miR-4316
ggugaggcuagcuggug

SEQ ID NO: 999 - RNA, 17 nt, Artificial sequence
  >hsa-miR-4317 MIMAT0016872 Homo sapiens miR-4317
acauugccagggaguuu

SEQ ID NO: 1000 - RNA, 17 nt, Artificial sequence
  >hsa-miR-4318 MIMAT0016869 Homo sapiens miR-4318
cacuguggguacaugcu

SEQ ID NO: 1001 - RNA, 17 nt, Artificial sequence
  >hsa-miR-4319 MIMAT0016870 Homo sapiens miR-4319
ucccugagcaaagccac

SEQ ID NO: 1002 - RNA, 21 nt, Artificial sequence
  >hsa-miR-432-3p MIMAT0002815 Homo sapiens miR-432-3p
cuggauggcuccuccaugucu

SEQ ID NO: 1003 - RNA, 23 nt, Artificial sequence
  >hsa-miR-432-5p MIMAT0002814 Homo sapiens miR-432-5p
ucuuggaguaggucauugggugg

SEQ ID NO: 1004 - RNA, 18 nt, Artificial sequence
  >hsa-miR-4320 MIMAT0016871 Homo sapiens miR-4320
gggauucuguagcuuccu

SEQ ID NO: 1005 - RNA, 21 nt, Artificial sequence
  >hsa-miR-4321 MIMAT0016874 Homo sapiens miR-4321
uuagcgguggaccgcccugcg

SEQ ID NO: 1006 - RNA, 21 nt, Artificial sequence
  >hsa-miR-4322 MIMAT0016873 Homo sapiens miR-4322
cugugggcucagcgcgugggg

SEQ ID NO: 1007 - RNA, 18 nt, Artificial sequence
  >hsa-miR-4323 MIMAT0016875 Homo sapiens miR-4323
cagccccacagccucaga

SEQ ID NO: 1008 - RNA, 20 nt, Artificial sequence
  >hsa-miR-4324 MIMAT0016876 Homo sapiens miR-4324
cccugagacccuaaccuuaa

SEQ ID NO: 1009 - RNA, 18 nt, Artificial sequence
  >hsa-miR-4325 MIMAT0016887 Homo sapiens miR-4325
uugcacuugucucaguga

SEQ ID NO: 1010 - RNA, 20 nt, Artificial sequence
  >hsa-miR-4326 MIMAT0016888 Homo sapiens miR-4326
uguuccucugucucccagac

SEQ ID NO: 1011 - RNA, 19 nt, Artificial sequence
  >hsa-miR-4327 MIMAT0016889 Homo sapiens miR-4327
ggcuugcaugggggacugg

SEQ ID NO: 1012 - RNA, 17 nt, Artificial sequence
  >hsa-miR-4328 MIMAT0016926 Homo sapiens miR-4328
ccaguuuucccaggauu

SEQ ID NO: 1013 - RNA, 19 nt, Artificial sequence
  >hsa-miR-4329 MIMAT0016923 Homo sapiens miR-4329
ccugagacccuaguuccac

SEQ ID NO: 1014 - RNA, 22 nt, Artificial sequence
  >hsa-miR-433-3p MIMAT0001627 Homo sapiens miR-433-3p
aucaugaugggcuccucggugu

SEQ ID NO: 1015 - RNA, 22 nt, Artificial sequence
  >hsa-miR-433-5p MIMAT0026554 Homo sapiens miR-433-5p
uacggugagccugucauuauuc

SEQ ID NO: 1016 - RNA, 19 nt, Artificial sequence
  >hsa-miR-4330 MIMAT0016924 Homo sapiens miR-4330
ccucagaucagagccuugc

SEQ ID NO: 1017 - RNA, 18 nt, Artificial sequence
  >hsa-miR-4417 MIMAT0018929 Homo sapiens miR-4417
ggugggcuucccggaggg

SEQ ID NO: 1018 - RNA, 18 nt, Artificial sequence
  >hsa-miR-4418 MIMAT0018930 Homo sapiens miR-4418
cacugcaggacucagcag

SEQ ID NO: 1019 - RNA, 17 nt, Artificial sequence
  >hsa-miR-4419a MIMAT0018931 Homo sapiens miR-4419a
ugagggaggagacugca

SEQ ID NO: 1020 - RNA, 18 nt, Artificial sequence
  >hsa-miR-4419b MIMAT0019034 Homo sapiens miR-4419b
gaggcugaaggaagaugg

SEQ ID NO: 1021 - RNA, 22 nt, Artificial sequence
  >hsa-miR-4420 MIMAT0018933 Homo sapiens miR-4420
gucacugaugucuguagcugag

SEQ ID NO: 1022 - RNA, 22 nt, Artificial sequence
  >hsa-miR-4421 MIMAT0018934 Homo sapiens miR-4421
accugucuguggaaaggagcua

SEQ ID NO: 1023 - RNA, 21 nt, Artificial sequence
  >hsa-miR-4422 MIMAT0018935 Homo sapiens miR-4422
aaaagcaucaggaaguaccca

SEQ ID NO: 1024 - RNA, 21 nt, Artificial sequence
  >hsa-miR-4423-3p MIMAT0018936 Homo sapiens miR-4423-3p
auaggcaccaaaaagcaacaa

SEQ ID NO: 1025 - RNA, 22 nt, Artificial sequence
  >hsa-miR-4423-5p MIMAT0019232 Homo sapiens miR-4423-5p
aguugccuuuuuguucccaugc

SEQ ID NO: 1026 - RNA, 22 nt, Artificial sequence
  >hsa-miR-4424 MIMAT0018939 Homo sapiens miR-4424
agaguuaacucaaaauggacua

SEQ ID NO: 1027 - RNA, 22 nt, Artificial sequence
  >hsa-miR-4425 MIMAT0018940 Homo sapiens miR-4425
uguugggauucagcaggaccau

SEQ ID NO: 1028 - RNA, 17 nt, Artificial sequence
  >hsa-miR-4426 MIMAT0018941 Homo sapiens miR-4426
gaagauggacguacuuu

SEQ ID NO: 1029 - RNA, 21 nt, Artificial sequence
  >hsa-miR-4427 MIMAT0018942 Homo sapiens miR-4427
ucugaauagagucugaagagu

SEQ ID NO: 1030 - RNA, 22 nt, Artificial sequence
  >hsa-miR-4428 MIMAT0018943 Homo sapiens miR-4428
caaggagacgggaacauggagc

SEQ ID NO: 1031 - RNA, 20 nt, Artificial sequence
  >hsa-miR-4429 MIMAT0018944 Homo sapiens miR-4429
aaaagcugggcugagaggcg

SEQ ID NO: 1032 - RNA, 18 nt, Artificial sequence
  >hsa-miR-4430 MIMAT0018945 Homo sapiens miR-4430
aggcuggagugagcggag

SEQ ID NO: 1033 - RNA, 22 nt, Artificial sequence
  >hsa-miR-4431 MIMAT0018947 Homo sapiens miR-4431
gcgacucugaaaacuagaaggu

SEQ ID NO: 1034 - RNA, 20 nt, Artificial sequence
  >hsa-miR-4432 MIMAT0018948 Homo sapiens miR-4432
aaagacucugcaagaugccu

SEQ ID NO: 1035 - RNA, 21 nt, Artificial sequence
  >hsa-miR-4433a-3p MIMAT0018949 Homo sapiens miR-4433a-3p
acaggagugggggugggacau

SEQ ID NO: 1036 - RNA, 21 nt, Artificial sequence
  >hsa-miR-4433a-5p MIMAT0020956 Homo sapiens miR-4433a-5p
cgucccaccccccacuccugu

SEQ ID NO: 1037 - RNA, 21 nt, Artificial sequence
  >hsa-miR-4433b-3p MIMAT0030414 Homo sapiens miR-4433b-3p
caggaguggggggugggacgu

SEQ ID NO: 1038 - RNA, 21 nt, Artificial sequence
  >hsa-miR-4433b-5p MIMAT0030413 Homo sapiens miR-4433b-5p
augucccacccccacuccugu

SEQ ID NO: 1039 - RNA, 18 nt, Artificial sequence
  >hsa-miR-4434 MIMAT0018950 Homo sapiens miR-4434
aggagaaguaaaguagaa

SEQ ID NO: 1040 - RNA, 22 nt, Artificial sequence
  >hsa-miR-4435 MIMAT0018951 Homo sapiens miR-4435
auggccagagcucacacagagg

SEQ ID NO: 1041 - RNA, 21 nt, Artificial sequence
  >hsa-miR-4436a MIMAT0018952 Homo sapiens miR-4436a
gcaggacaggcagaaguggau

SEQ ID NO: 1042 - RNA, 22 nt, Artificial sequence
  >hsa-miR-4436b-3p MIMAT0019941 Homo sapiens miR-4436b-3p
cagggcaggaagaaguggacaa

SEQ ID NO: 1043 - RNA, 22 nt, Artificial sequence
  >hsa-miR-4436b-5p MIMAT0019940 Homo sapiens miR-4436b-5p
guccacuucugccugcccugcc

SEQ ID NO: 1044 - RNA, 21 nt, Artificial sequence
  >hsa-miR-4437 MIMAT0018953 Homo sapiens miR-4437
ugggcucaggguacaaagguu

SEQ ID NO: 1045 - RNA, 21 nt, Artificial sequence
  >hsa-miR-4438 MIMAT0018956 Homo sapiens miR-4438
cacaggcuuagaaaagacagu

SEQ ID NO: 1046 - RNA, 22 nt, Artificial sequence
  >hsa-miR-4439 MIMAT0018957 Homo sapiens miR-4439
gugacugauaccuuggaggcau

SEQ ID NO: 1047 - RNA, 22 nt, Artificial sequence
  >hsa-miR-4440 MIMAT0018958 Homo sapiens miR-4440
ugucguggggcuugcuggcuug

SEQ ID NO: 1048 - RNA, 17 nt, Artificial sequence
  >hsa-miR-4441 MIMAT0018959 Homo sapiens miR-4441
acagggaggagauugua

SEQ ID NO: 1049 - RNA, 17 nt, Artificial sequence
  >hsa-miR-4442 MIMAT0018960 Homo sapiens miR-4442
gccggacaagagggagg

SEQ ID NO: 1050 - RNA, 17 nt, Artificial sequence
  >hsa-miR-4443 MIMAT0018961 Homo sapiens miR-4443
uuggaggcguggguuuu

SEQ ID NO: 1051 - RNA, 18 nt, Artificial sequence
  >hsa-miR-4444 MIMAT0018962 Homo sapiens miR-4444
cucgaguuggaagaggcg

SEQ ID NO: 1052 - RNA, 21 nt, Artificial sequence
  >hsa-miR-4445-3p MIMAT0018964 Homo sapiens miR-4445-3p
cacggcaaaagaaacaaucca

SEQ ID NO: 1053 - RNA, 22 nt, Artificial sequence
  >hsa-miR-4445-5p MIMAT0018963 Homo sapiens miR-4445-5p
agauuguuucuuuugccgugca

SEQ ID NO: 1054 - RNA, 22 nt, Artificial sequence
  >hsa-miR-4446-3p MIMAT0018965 Homo sapiens miR-4446-3p
cagggcuggcagugacaugggu

SEQ ID NO: 1055 - RNA, 22 nt, Artificial sequence
  >hsa-miR-4446-5p MIMAT0019233 Homo sapiens miR-4446-5p
auuucccugccauucccuuggc

SEQ ID NO: 1056 - RNA, 17 nt, Artificial sequence
  >hsa-miR-4447 MIMAT0018966 Homo sapiens miR-4447
ggugggggcuguuguuu

SEQ ID NO: 1057 - RNA, 20 nt, Artificial sequence
  >hsa-miR-4448 MIMAT0018967 Homo sapiens miR-4448
ggcuccuuggucuaggggua

SEQ ID NO: 1058 - RNA, 22 nt, Artificial sequence
  >hsa-miR-4449 MIMAT0018968 Homo sapiens miR-4449
cgucccggggcugcgcgaggca

SEQ ID NO: 1059 - RNA, 22 nt, Artificial sequence
  >hsa-miR-4450 MIMAT0018971 Homo sapiens miR-4450
uggggauuuggagaagugguga

SEQ ID NO: 1060 - RNA, 17 nt, Artificial sequence
  >hsa-miR-4451 MIMAT0018973 Homo sapiens miR-4451
ugguagagcugaggaca

SEQ ID NO: 1061 - RNA, 23 nt, Artificial sequence
  >hsa-miR-4452 MIMAT0018974 Homo sapiens miR-4452
uugaauucuuggccuuaagugau

SEQ ID NO: 1062 - RNA, 20 nt, Artificial sequence
  >hsa-miR-4453 MIMAT0018975 Homo sapiens miR-4453
gagcuuggucuguagcgguu

SEQ ID NO: 1063 - RNA, 20 nt, Artificial sequence
  >hsa-miR-4454 MIMAT0018976 Homo sapiens miR-4454
ggauccgagucacggcacca

SEQ ID NO: 1064 - RNA, 17 nt, Artificial sequence
  >hsa-miR-4455 MIMAT0018977 Homo sapiens miR-4455
aggguguguguguuuuu

SEQ ID NO: 1065 - RNA, 17 nt, Artificial sequence
  >hsa-miR-4456 MIMAT0018978 Homo sapiens miR-4456
ccugguggcuuccuuuu

SEQ ID NO: 1066 - RNA, 22 nt, Artificial sequence
  >hsa-miR-4457 MIMAT0018979 Homo sapiens miR-4457
ucacaagguauugacuggcgua

SEQ ID NO: 1067 - RNA, 19 nt, Artificial sequence
  >hsa-miR-4458 MIMAT0018980 Homo sapiens miR-4458
agagguagguguggaagaa

SEQ ID NO: 1068 - RNA, 22 nt, Artificial sequence
  >hsa-miR-4459 MIMAT0018981 Homo sapiens miR-4459
ccaggaggcggaggagguggag

SEQ ID NO: 1069 - RNA, 22 nt, Artificial sequence
  >hsa-miR-4460 MIMAT0018982 Homo sapiens miR-4460
auagugguugugaauuuaccuu

SEQ ID NO: 1070 - RNA, 23 nt, Artificial sequence
  >hsa-miR-4461 MIMAT0018983 Homo sapiens miR-4461
gauugagacuaguagggcuaggc

SEQ ID NO: 1071 - RNA, 23 nt, Artificial sequence
  >hsa-miR-4462 MIMAT0018986 Homo sapiens miR-4462
ugacacggaggguggcuugggaa

SEQ ID NO: 1072 - RNA, 17 nt, Artificial sequence
  >hsa-miR-4463 MIMAT0018987 Homo sapiens miR-4463
gagacugggguggggcc

SEQ ID NO: 1073 - RNA, 21 nt, Artificial sequence
  >hsa-miR-4464 MIMAT0018988 Homo sapiens miR-4464
aagguuuggauagaugcaaua

SEQ ID NO: 1074 - RNA, 22 nt, Artificial sequence
  >hsa-miR-4465 MIMAT0018992 Homo sapiens miR-4465
cucaaguagucugaccagggga

SEQ ID NO: 1075 - RNA, 18 nt, Artificial sequence
  >hsa-miR-4466 MIMAT0018993 Homo sapiens miR-4466
gggugcgggccggcgggg

SEQ ID NO: 1076 - RNA, 22 nt, Artificial sequence
  >hsa-miR-4467 MIMAT0018994 Homo sapiens miR-4467
uggcggcgguaguuaugggcuu

SEQ ID NO: 1077 - RNA, 18 nt, Artificial sequence
  >hsa-miR-4468 MIMAT0018995 Homo sapiens miR-4468
agagcagaaggaugagau

SEQ ID NO: 1078 - RNA, 22 nt, Artificial sequence
  >hsa-miR-4469 MIMAT0018996 Homo sapiens miR-4469
gcucccucuagggucgcucgga

SEQ ID NO: 1079 - RNA, 21 nt, Artificial sequence
  >hsa-miR-4470 MIMAT0018997 Homo sapiens miR-4470
uggcaaacguggaagccgaga

SEQ ID NO: 1080 - RNA, 22 nt, Artificial sequence
  >hsa-miR-4471 MIMAT0018998 Homo sapiens miR-4471
ugggaacuuaguagagguuuaa

SEQ ID NO: 1081 - RNA, 18 nt, Artificial sequence
  >hsa-miR-4472 MIMAT0018999 Homo sapiens miR-4472
ggugggggguguuguuuu

SEQ ID NO: 1082 - RNA, 22 nt, Artificial sequence
  >hsa-miR-4473 MIMAT0019000 Homo sapiens miR-4473
cuagugcucuccguuacaagua

SEQ ID NO: 1083 - RNA, 22 nt, Artificial sequence
  >hsa-miR-4474-3p MIMAT0019001 Homo sapiens miR-4474-3p
uuguggcuggucaugaggcuaa

SEQ ID NO: 1084 - RNA, 21 nt, Artificial sequence
  >hsa-miR-4474-5p MIMAT0019234 Homo sapiens miR-4474-5p
uuagucucaugaucagacaca

SEQ ID NO: 1085 - RNA, 22 nt, Artificial sequence
  >hsa-miR-4475 MIMAT0019002 Homo sapiens miR-4475
caagggaccaagcauucauuau

SEQ ID NO: 1086 - RNA, 22 nt, Artificial sequence
  >hsa-miR-4476 MIMAT0019003 Homo sapiens miR-4476
caggaaggauuuagggacaggc

SEQ ID NO: 1087 - RNA, 22 nt, Artificial sequence
  >hsa-miR-4477a MIMAT0019004 Homo sapiens miR-4477a
cuauuaaggacauuugugauuc

SEQ ID NO: 1088 - RNA, 22 nt, Artificial sequence
  >hsa-miR-4477b MIMAT0019005 Homo sapiens miR-4477b
auuaaggacauuugugauugau

SEQ ID NO: 1089 - RNA, 17 nt, Artificial sequence
  >hsa-miR-4478 MIMAT0019006 Homo sapiens miR-4478
gaggcugagcugaggag

SEQ ID NO: 1090 - RNA, 22 nt, Artificial sequence
  >hsa-miR-4479 MIMAT0019011 Homo sapiens miR-4479
cgcgcggccgugcucggagcag

SEQ ID NO: 1091 - RNA, 22 nt, Artificial sequence
  >hsa-miR-448 MIMAT0001532 Homo sapiens miR-448
uugcauauguaggaugucccau

SEQ ID NO: 1092 - RNA, 21 nt, Artificial sequence
  >hsa-miR-4480 MIMAT0019014 Homo sapiens miR-4480
agccaaguggaaguuacuuua

SEQ ID NO: 1093 - RNA, 17 nt, Artificial sequence
  >hsa-miR-4481 MIMAT0019015 Homo sapiens miR-4481
ggagugggcuggugguu

SEQ ID NO: 1094 - RNA, 22 nt, Artificial sequence
  >hsa-miR-4482-3p MIMAT0020958 Homo sapiens miR-4482-3p
uuucuauuucucaguggggcuc

SEQ ID NO: 1095 - RNA, 22 nt, Artificial sequence
  >hsa-miR-4482-5p MIMAT0019016 Homo sapiens miR-4482-5p
aacccagugggcuauggaaaug

SEQ ID NO: 1096 - RNA, 17 nt, Artificial sequence
  >hsa-miR-4483 MIMAT0019017 Homo sapiens miR-4483
gggguggucuguuguug

SEQ ID NO: 1097 - RNA, 20 nt, Artificial sequence
  >hsa-miR-4484 MIMAT0019018 Homo sapiens miR-4484
aaaaggcgggagaagcccca

SEQ ID NO: 1098 - RNA, 20 nt, Artificial sequence
  >hsa-miR-4485-3p MIMAT0019019 Homo sapiens miR-4485-3p
uaacggccgcgguacccuaa

SEQ ID NO: 1099 - RNA, 16 nt, Artificial sequence
  >hsa-miR-4485-5p MIMAT0032116 Homo sapiens miR-4485-5p
accgccugcccaguga

SEQ ID NO: 1100 - RNA, 17 nt, Artificial sequence
  >hsa-miR-4486 MIMAT0019020 Homo sapiens miR-4486
gcugggcgaggcuggca

SEQ ID NO: 1101 - RNA, 19 nt, Artificial sequence
  >hsa-miR-4487 MIMAT0019021 Homo sapiens miR-4487
agagcuggcugaagggcag

SEQ ID NO: 1102 - RNA, 18 nt, Artificial sequence
  >hsa-miR-4488 MIMAT0019022 Homo sapiens miR-4488
agggggcgggcuccggcg

SEQ ID NO: 1103 - RNA, 21 nt, Artificial sequence
  >hsa-miR-4489 MIMAT0019023 Homo sapiens miR-4489
uggggcuagugaugcaggacg

SEQ ID NO: 1104 - RNA, 22 nt, Artificial sequence
  >hsa-miR-4490 MIMAT0019025 Homo sapiens miR-4490
ucugguaagagauuugggcaua

SEQ ID NO: 1105 - RNA, 22 nt, Artificial sequence
  >hsa-miR-4491 MIMAT0019026 Homo sapiens miR-4491
aauguggacuggugugaccaaa

SEQ ID NO: 1106 - RNA, 17 nt, Artificial sequence
  >hsa-miR-4492 MIMAT0019027 Homo sapiens miR-4492
ggggcugggcgcgcgcc

SEQ ID NO: 1107 - RNA, 21 nt, Artificial sequence
  >hsa-miR-4493 MIMAT0019028 Homo sapiens miR-4493
agaaggccuuuccaucucugu

SEQ ID NO: 1108 - RNA, 22 nt, Artificial sequence
  >hsa-miR-4494 MIMAT0019029 Homo sapiens miR-4494
ccagacuguggcugaccagagg

SEQ ID NO: 1109 - RNA, 21 nt, Artificial sequence
  >hsa-miR-4495 MIMAT0019030 Homo sapiens miR-4495
aauguaaacaggcuuuuugcu

SEQ ID NO: 1110 - RNA, 22 nt, Artificial sequence
  >hsa-miR-4496 MIMAT0019031 Homo sapiens miR-4496
gaggaaacugaagcugagaggg

SEQ ID NO: 1111 - RNA, 17 nt, Artificial sequence
  >hsa-miR-4497 MIMAT0019032 Homo sapiens miR-4497
cuccgggacggcugggc

SEQ ID NO: 1112 - RNA, 22 nt, Artificial sequence
  >hsa-miR-4498 MIMAT0019033 Homo sapiens miR-4498
ugggcuggcagggcaagugcug

SEQ ID NO: 1113 - RNA, 17 nt, Artificial sequence
  >hsa-miR-4499 MIMAT0019035 Homo sapiens miR-4499
aagacugagaggaggga

SEQ ID NO: 1114 - RNA, 22 nt, Artificial sequence
  >hsa-miR-449a MIMAT0001541 Homo sapiens miR-449a
uggcaguguauuguuagcuggu

SEQ ID NO: 1115 - RNA, 22 nt, Artificial sequence
  >hsa-miR-449b-3p MIMAT0009203 Homo sapiens miR-449b-3p
cagccacaacuacccugccacu

SEQ ID NO: 1116 - RNA, 22 nt, Artificial sequence
  >hsa-miR-449b-5p MIMAT0003327 Homo sapiens miR-449b-5p
aggcaguguauuguuagcuggc

SEQ ID NO: 1117 - RNA, 23 nt, Artificial sequence
  >hsa-miR-449c-3p MIMAT0013771 Homo sapiens miR-449c-3p
uugcuaguugcacuccucucugu

SEQ ID NO: 1118 - RNA, 25 nt, Artificial sequence
  >hsa-miR-449c-5p MIMAT0010251 Homo sapiens miR-449c-5p
uaggcaguguauugcuagcggcugu

SEQ ID NO: 1119 - RNA, 17 nt, Artificial sequence
  >hsa-miR-4500 MIMAT0019036 Homo sapiens miR-4500
ugagguaguaguuucuu

SEQ ID NO: 1120 - RNA, 21 nt, Artificial sequence
  >hsa-miR-4501 MIMAT0019037 Homo sapiens miR-4501
uaugugaccucggaugaauca

SEQ ID NO: 1121 - RNA, 22 nt, Artificial sequence
  >hsa-miR-4502 MIMAT0019038 Homo sapiens miR-4502
gcugaugaugauggugcugaag

SEQ ID NO: 1122 - RNA, 22 nt, Artificial sequence
  >hsa-miR-4503 MIMAT0019039 Homo sapiens miR-4503
uuuaagcaggaaauagaauuua

SEQ ID NO: 1123 - RNA, 22 nt, Artificial sequence
  >hsa-miR-4504 MIMAT0019040 Homo sapiens miR-4504
ugugacaauagagaugaacaug

SEQ ID NO: 1124 - RNA, 18 nt, Artificial sequence
  >hsa-miR-4505 MIMAT0019041 Homo sapiens miR-4505
aggcugggcugggacgga

SEQ ID NO: 1125 - RNA, 20 nt, Artificial sequence
  >hsa-miR-4506 MIMAT0019042 Homo sapiens miR-4506
aaauggguggucugaggcaa

SEQ ID NO: 1126 - RNA, 20 nt, Artificial sequence
  >hsa-miR-4507 MIMAT0019044 Homo sapiens miR-4507
cuggguugggcugggcuggg

SEQ ID NO: 1127 - RNA, 17 nt, Artificial sequence
  >hsa-miR-4508 MIMAT0019045 Homo sapiens miR-4508
gcggggcugggcgcgcg

SEQ ID NO: 1128 - RNA, 22 nt, Artificial sequence
  >hsa-miR-4509 MIMAT0019046 Homo sapiens miR-4509
acuaaaggauauagaagguuuu

SEQ ID NO: 1129 - RNA, 22 nt, Artificial sequence
  >hsa-miR-450a-1-3p MIMAT0022700 Homo sapiens miR-450a-1-3p
auugggaacauuuugcauguau

SEQ ID NO: 1130 - RNA, 22 nt, Artificial sequence
  >hsa-miR-450a-2-3p MIMAT0031074 Homo sapiens miR-450a-2-3p
auuggggacauuuugcauucau

SEQ ID NO: 1131 - RNA, 22 nt, Artificial sequence
  >hsa-miR-450a-5p MIMAT0001545 Homo sapiens miR-450a-5p
uuuugcgauguguuccuaauau

SEQ ID NO: 1132 - RNA, 22 nt, Artificial sequence
  >hsa-miR-450b-3p MIMAT0004910 Homo sapiens miR-450b-3p
uugggaucauuuugcauccaua

SEQ ID NO: 1133 - RNA, 22 nt, Artificial sequence
  >hsa-miR-450b-5p MIMAT0004909 Homo sapiens miR-450b-5p
uuuugcaauauguuccugaaua

SEQ ID NO: 1134 - RNA, 22 nt, Artificial sequence
  >hsa-miR-4510 MIMAT0019047 Homo sapiens miR-4510
ugagggaguaggauguaugguu

SEQ ID NO: 1135 - RNA, 22 nt, Artificial sequence
  >hsa-miR-4511 MIMAT0019048 Homo sapiens miR-4511
gaagaacuguugcauuugcccu

SEQ ID NO: 1136 - RNA, 22 nt, Artificial sequence
  >hsa-miR-4512 MIMAT0019049 Homo sapiens miR-4512
cagggccucacuguaucgccca

SEQ ID NO: 1137 - RNA, 22 nt, Artificial sequence
  >hsa-miR-4513 MIMAT0019050 Homo sapiens miR-4513
agacugacggcuggaggcccau

SEQ ID NO: 1138 - RNA, 18 nt, Artificial sequence
  >hsa-miR-4514 MIMAT0019051 Homo sapiens miR-4514
acaggcaggauuggggaa

SEQ ID NO: 1139 - RNA, 22 nt, Artificial sequence
  >hsa-miR-4515 MIMAT0019052 Homo sapiens miR-4515
aggacuggacucccggcagccc

SEQ ID NO: 1140 - RNA, 17 nt, Artificial sequence
  >hsa-miR-4516 MIMAT0019053 Homo sapiens miR-4516
gggagaagggucggggc

SEQ ID NO: 1141 - RNA, 25 nt, Artificial sequence
  >hsa-miR-4517 MIMAT0019054 Homo sapiens miR-4517
aaauaugaugaaacucacagcugag

SEQ ID NO: 1142 - RNA, 26 nt, Artificial sequence
  >hsa-miR-4518 MIMAT0019055 Homo sapiens miR-4518
gcucagggaugauaacugugcugaga

SEQ ID NO: 1143 - RNA, 18 nt, Artificial sequence
  >hsa-miR-4519 MIMAT0019056 Homo sapiens miR-4519
cagcagugcgcagggcug

SEQ ID NO: 1144 - RNA, 22 nt, Artificial sequence
  >hsa-miR-451a MIMAT0001631 Homo sapiens miR-451a
aaaccguuaccauuacugaguu

SEQ ID NO: 1145 - RNA, 22 nt, Artificial sequence
  >hsa-miR-451b MIMAT0019840 Homo sapiens miR-451b
uagcaagagaaccauuaccauu

SEQ ID NO: 1146 - RNA, 22 nt, Artificial sequence
  >hsa-miR-452-3p MIMAT0001636 Homo sapiens miR-452-3p
cucaucugcaaagaaguaagug

SEQ ID NO: 1147 - RNA, 22 nt, Artificial sequence
  >hsa-miR-452-5p MIMAT0001635 Homo sapiens miR-452-5p
aacuguuugcagaggaaacuga

SEQ ID NO: 1148 - RNA, 22 nt, Artificial sequence
  >hsa-miR-4520-2-3p MIMAT0020300 Homo sapiens miR-4520-2-3p
uuuggacagaaaacacgcaggu

SEQ ID NO: 1149 - RNA, 22 nt, Artificial sequence
  >hsa-miR-4520-3p MIMAT0019057 Homo sapiens miR-4520-3p
uuggacagaaaacacgcaggaa

SEQ ID NO: 1150 - RNA, 20 nt, Artificial sequence
  >hsa-miR-4520-5p MIMAT0019235 Homo sapiens miR-4520-5p
ccugcguguuuucuguccaa

SEQ ID NO: 1151 - RNA, 22 nt, Artificial sequence
  >hsa-miR-4521 MIMAT0019058 Homo sapiens miR-4521
gcuaaggaaguccugugcucag

SEQ ID NO: 1152 - RNA, 21 nt, Artificial sequence
  >hsa-miR-4522 MIMAT0019060 Homo sapiens miR-4522
ugacucugccuguaggccggu

SEQ ID NO: 1153 - RNA, 21 nt, Artificial sequence
  >hsa-miR-4523 MIMAT0019061 Homo sapiens miR-4523
gaccgagagggccucggcugu

SEQ ID NO: 1154 - RNA, 22 nt, Artificial sequence
  >hsa-miR-4524a-3p MIMAT0019063 Homo sapiens miR-4524a-3p
ugagacaggcuuaugcugcuau

SEQ ID NO: 1155 - RNA, 22 nt, Artificial sequence
  >hsa-miR-4524a-5p MIMAT0019062 Homo sapiens miR-4524a-5p
auagcagcaugaaccugucuca

SEQ ID NO: 1156 - RNA, 20 nt, Artificial sequence
  >hsa-miR-4524b-3p MIMAT0022256 Homo sapiens miR-4524b-3p
gagacagguucaugcugcua

SEQ ID NO: 1157 - RNA, 21 nt, Artificial sequence
  >hsa-miR-4524b-5p MIMAT0022255 Homo sapiens miR-4524b-5p
auagcagcauaagccugucuc

SEQ ID NO: 1158 - RNA, 21 nt, Artificial sequence
  >hsa-miR-4525 MIMAT0019064 Homo sapiens miR-4525
ggggggaugugcaugcugguu

SEQ ID NO: 1159 - RNA, 22 nt, Artificial sequence
  >hsa-miR-4526 MIMAT0019065 Homo sapiens miR-4526
gcugacagcagggcuggccgcu

SEQ ID NO: 1160 - RNA, 22 nt, Artificial sequence
  >hsa-miR-4527 MIMAT0019066 Homo sapiens miR-4527
uggucugcaaagagaugacugu

SEQ ID NO: 1161 - RNA, 22 nt, Artificial sequence
  >hsa-miR-4528 MIMAT0019067 Homo sapiens miR-4528
ucauuauauguaugaucuggac

SEQ ID NO: 1162 - RNA, 21 nt, Artificial sequence
  >hsa-miR-4529-3p MIMAT0019068 Homo sapiens miR-4529-3p
auuggacugcugauggcccgu

SEQ ID NO: 1163 - RNA, 22 nt, Artificial sequence
  >hsa-miR-4529-5p MIMAT0019236 Homo sapiens miR-4529-5p
aggccaucagcaguccaaugaa

SEQ ID NO: 1164 - RNA, 18 nt, Artificial sequence
  >hsa-miR-4530 MIMAT0019069 Homo sapiens miR-4530
cccagcaggacgggagcg

SEQ ID NO: 1165 - RNA, 17 nt, Artificial sequence
  >hsa-miR-4531 MIMAT0019070 Homo sapiens miR-4531
auggagaaggcuucuga

SEQ ID NO: 1166 - RNA, 17 nt, Artificial sequence
  >hsa-miR-4532 MIMAT0019071 Homo sapiens miR-4532
ccccggggagcccggcg

SEQ ID NO: 1167 - RNA, 22 nt, Artificial sequence
  >hsa-miR-4533 MIMAT0019072 Homo sapiens miR-4533
uggaaggagguugccggacgcu

SEQ ID NO: 1168 - RNA, 17 nt, Artificial sequence
  >hsa-miR-4534 MIMAT0019073 Homo sapiens miR-4534
ggauggaggaggggucu

SEQ ID NO: 1169 - RNA, 17 nt, Artificial sequence
  >hsa-miR-4535 MIMAT0019075 Homo sapiens miR-4535
guggaccuggcugggac

SEQ ID NO: 1170 - RNA, 21 nt, Artificial sequence
  >hsa-miR-4536-3p MIMAT0020959 Homo sapiens miR-4536-3p
ucgugcauauaucuaccacau

SEQ ID NO: 1171 - RNA, 21 nt, Artificial sequence
  >hsa-miR-4536-5p MIMAT0019078 Homo sapiens miR-4536-5p
ugugguagauauaugcacgau

SEQ ID NO: 1172 - RNA, 22 nt, Artificial sequence
  >hsa-miR-4537 MIMAT0019080 Homo sapiens miR-4537
ugagccgagcugagcuuagcug

SEQ ID NO: 1173 - RNA, 22 nt, Artificial sequence
  >hsa-miR-4538 MIMAT0019081 Homo sapiens miR-4538
gagcuuggaugagcugggcuga

SEQ ID NO: 1174 - RNA, 22 nt, Artificial sequence
  >hsa-miR-4539 MIMAT0019082 Homo sapiens miR-4539
gcugaacugggcugagcugggc

SEQ ID NO: 1175 - RNA, 23 nt, Artificial sequence
  >hsa-miR-454-3p MIMAT0003885 Homo sapiens miR-454-3p
uagugcaauauugcuuauagggu

SEQ ID NO: 1176 - RNA, 22 nt, Artificial sequence
  >hsa-miR-454-5p MIMAT0003884 Homo sapiens miR-454-5p
acccuaucaauauugucucugc

SEQ ID NO: 1177 - RNA, 21 nt, Artificial sequence
  >hsa-miR-4540 MIMAT0019083 Homo sapiens miR-4540
uuaguccugccuguagguuua

SEQ ID NO: 1178 - RNA, 21 nt, Artificial sequence
  >hsa-miR-455-3p MIMAT0004784 Homo sapiens miR-455-3p
gcaguccaugggcauauacac

SEQ ID NO: 1179 - RNA, 22 nt, Artificial sequence
  >hsa-miR-455-5p MIMAT0003150 Homo sapiens miR-455-5p
uaugugccuuuggacuacaucg

SEQ ID NO: 1180 - RNA, 22 nt, Artificial sequence
  >hsa-miR-4632-3p MIMAT0019688 Homo sapiens miR-4632-3p
ugccgcccucucgcugcucuag

SEQ ID NO: 1181 - RNA, 23 nt, Artificial sequence
  >hsa-miR-4632-5p MIMAT0022977 Homo sapiens miR-4632-5p
gagggcagcguggguguggcgga

SEQ ID NO: 1182 - RNA, 22 nt, Artificial sequence
  >hsa-miR-4633-3p MIMAT0019690 Homo sapiens miR-4633-3p
aggagcuagccaggcauaugca

SEQ ID NO: 1183 - RNA, 20 nt, Artificial sequence
  >hsa-miR-4633-5p MIMAT0019689 Homo sapiens miR-4633-5p
auaugccuggcuagcuccuc

SEQ ID NO: 1184 - RNA, 19 nt, Artificial sequence
  >hsa-miR-4634 MIMAT0019691 Homo sapiens miR-4634
cggcgcgaccggcccgggg

SEQ ID NO: 1185 - RNA, 21 nt, Artificial sequence
  >hsa-miR-4635 MIMAT0019692 Homo sapiens miR-4635
ucuugaagucagaacccgcaa

SEQ ID NO: 1186 - RNA, 22 nt, Artificial sequence
  >hsa-miR-4636 MIMAT0019693 Homo sapiens miR-4636
aacucguguucaaagccuuuag

SEQ ID NO: 1187 - RNA, 22 nt, Artificial sequence
  >hsa-miR-4637 MIMAT0019694 Homo sapiens miR-4637
uacuaacugcagauucaaguga

SEQ ID NO: 1188 - RNA, 23 nt, Artificial sequence
  >hsa-miR-4638-3p MIMAT0019696 Homo sapiens miR-4638-3p
ccuggacaccgcucagccggccg

SEQ ID NO: 1189 - RNA, 21 nt, Artificial sequence
  >hsa-miR-4638-5p MIMAT0019695 Homo sapiens miR-4638-5p
acucggcugcgguggacaagu

SEQ ID NO: 1190 - RNA, 20 nt, Artificial sequence
  >hsa-miR-4639-3p MIMAT0019698 Homo sapiens miR-4639-3p
ucacucucaccuugcuuugc

SEQ ID NO: 1191 - RNA, 22 nt, Artificial sequence
  >hsa-miR-4639-5p MIMAT0019697 Homo sapiens miR-4639-5p
uugcuaaguaggcugagauuga

SEQ ID NO: 1192 - RNA, 22 nt, Artificial sequence
  >hsa-miR-4640-3p MIMAT0019700 Homo sapiens miR-4640-3p
cacccccuguuuccuggcccac

SEQ ID NO: 1193 - RNA, 23 nt, Artificial sequence
  >hsa-miR-4640-5p MIMAT0019699 Homo sapiens miR-4640-5p
ugggccagggagcagcugguggg

SEQ ID NO: 1194 - RNA, 24 nt, Artificial sequence
  >hsa-miR-4641 MIMAT0019701 Homo sapiens miR-4641
ugcccaugccauacuuuugccuca

SEQ ID NO: 1195 - RNA, 22 nt, Artificial sequence
  >hsa-miR-4642 MIMAT0019702 Homo sapiens miR-4642
auggcaucguccccugguggcu

SEQ ID NO: 1196 - RNA, 22 nt, Artificial sequence
  >hsa-miR-4643 MIMAT0019703 Homo sapiens miR-4643
gacacaugaccauaaaugcuaa

SEQ ID NO: 1197 - RNA, 23 nt, Artificial sequence
  >hsa-miR-4644 MIMAT0019704 Homo sapiens miR-4644
uggagagagaaaagagacagaag

SEQ ID NO: 1198 - RNA, 22 nt, Artificial sequence
  >hsa-miR-4645-3p MIMAT0019706 Homo sapiens miR-4645-3p
agacaguaguucuugccugguu

SEQ ID NO: 1199 - RNA, 19 nt, Artificial sequence
  >hsa-miR-4645-5p MIMAT0019705 Homo sapiens miR-4645-5p
accaggcaagaaauauugu

SEQ ID NO: 1200 - RNA, 21 nt, Artificial sequence
  >hsa-miR-4646-3p MIMAT0019708 Homo sapiens miR-4646-3p
auugucccucucccuucccag

SEQ ID NO: 1201 - RNA, 22 nt, Artificial sequence
  >hsa-miR-4646-5p MIMAT0019707 Homo sapiens miR-4646-5p
acugggaagaggagcugaggga

SEQ ID NO: 1202 - RNA, 23 nt, Artificial sequence
  >hsa-miR-4647 MIMAT0019709 Homo sapiens miR-4647
gaagauggugcugugcugaggaa

SEQ ID NO: 1203 - RNA, 20 nt, Artificial sequence
  >hsa-miR-4648 MIMAT0019710 Homo sapiens miR-4648
ugugggacugcaaaugggag

SEQ ID NO: 1204 - RNA, 21 nt, Artificial sequence
  >hsa-miR-4649-3p MIMAT0019712 Homo sapiens miR-4649-3p
ucugaggccugccucucccca

SEQ ID NO: 1205 - RNA, 24 nt, Artificial sequence
  >hsa-miR-4649-5p MIMAT0019711 Homo sapiens miR-4649-5p
ugggcgaggggugggcucucagag

SEQ ID NO: 1206 - RNA, 21 nt, Artificial sequence
  >hsa-miR-4650-3p MIMAT0019714 Homo sapiens miR-4650-3p
agguagaaugaggccugacau

SEQ ID NO: 1207 - RNA, 19 nt, Artificial sequence
  >hsa-miR-4650-5p MIMAT0019713 Homo sapiens miR-4650-5p
ucaggccucuuucuaccuu

SEQ ID NO: 1208 - RNA, 20 nt, Artificial sequence
  >hsa-miR-4651 MIMAT0019715 Homo sapiens miR-4651
cggggugggugaggucgggc

SEQ ID NO: 1209 - RNA, 22 nt, Artificial sequence
  >hsa-miR-4652-3p MIMAT0019717 Homo sapiens miR-4652-3p
guucuguuaacccauccccuca

SEQ ID NO: 1210 - RNA, 22 nt, Artificial sequence
  >hsa-miR-4652-5p MIMAT0019716 Homo sapiens miR-4652-5p
aggggacugguuaauagaacua

SEQ ID NO: 1211 - RNA, 23 nt, Artificial sequence
  >hsa-miR-4653-3p MIMAT0019719 Homo sapiens miR-4653-3p
uggaguuaaggguugcuuggaga

SEQ ID NO: 1212 - RNA, 22 nt, Artificial sequence
  >hsa-miR-4653-5p MIMAT0019718 Homo sapiens miR-4653-5p
ucucugagcaaggcuuaacacc

SEQ ID NO: 1213 - RNA, 22 nt, Artificial sequence
  >hsa-miR-4654 MIMAT0019720 Homo sapiens miR-4654
ugugggaucuggaggcaucugg

SEQ ID NO: 1214 - RNA, 21 nt, Artificial sequence
  >hsa-miR-4655-3p MIMAT0019722 Homo sapiens miR-4655-3p
acccucgucagguccccgggg

SEQ ID NO: 1215 - RNA, 22 nt, Artificial sequence
  >hsa-miR-4655-5p MIMAT0019721 Homo sapiens miR-4655-5p
caccggggauggcagagggucg

SEQ ID NO: 1216 - RNA, 23 nt, Artificial sequence
  >hsa-miR-4656 MIMAT0019723 Homo sapiens miR-4656
ugggcugagggcaggaggccugu

SEQ ID NO: 1217 - RNA, 23 nt, Artificial sequence
  >hsa-miR-4657 MIMAT0019724 Homo sapiens miR-4657
aauguggaaguggucugaggcau

SEQ ID NO: 1218 - RNA, 23 nt, Artificial sequence
  >hsa-miR-4658 MIMAT0019725 Homo sapiens miR-4658
gugaguguggauccuggaggaau

SEQ ID NO: 1219 - RNA, 22 nt, Artificial sequence
  >hsa-miR-4659a-3p MIMAT0019727 Homo sapiens miR-4659a-3p
uuucuucuuagacauggcaacg

SEQ ID NO: 1220 - RNA, 22 nt, Artificial sequence
  >hsa-miR-4659a-5p MIMAT0019726 Homo sapiens miR-4659a-5p
cugccaugucuaagaagaaaac

SEQ ID NO: 1221 - RNA, 22 nt, Artificial sequence
  >hsa-miR-4659b-3p MIMAT0019734 Homo sapiens miR-4659b-3p
uuucuucuuagacauggcagcu

SEQ ID NO: 1222 - RNA, 19 nt, Artificial sequence
  >hsa-miR-4659b-5p MIMAT0019733 Homo sapiens miR-4659b-5p
uugccaugucuaagaagaa

SEQ ID NO: 1223 - RNA, 23 nt, Artificial sequence
  >hsa-miR-466 MIMAT0015002 Homo sapiens miR-466
auacacauacacgcaacacacau

SEQ ID NO: 1224 - RNA, 23 nt, Artificial sequence
  >hsa-miR-4660 MIMAT0019728 Homo sapiens miR-4660
ugcagcucugguggaaaauggag

SEQ ID NO: 1225 - RNA, 22 nt, Artificial sequence
  >hsa-miR-4661-3p MIMAT0019730 Homo sapiens miR-4661-3p
caggauccacagagcuagucca

SEQ ID NO: 1226 - RNA, 22 nt, Artificial sequence
  >hsa-miR-4661-5p MIMAT0019729 Homo sapiens miR-4661-5p
aacuagcucuguggauccugac

SEQ ID NO: 1227 - RNA, 22 nt, Artificial sequence
  >hsa-miR-4662a-3p MIMAT0019732 Homo sapiens miR-4662a-3p
aaagauagacaauuggcuaaau

SEQ ID NO: 1228 - RNA, 22 nt, Artificial sequence
  >hsa-miR-4662a-5p MIMAT0019731 Homo sapiens miR-4662a-5p
uuagccaauuguccaucuuuag

SEQ ID NO: 1229 - RNA, 22 nt, Artificial sequence
  >hsa-miR-4662b MIMAT0019736 Homo sapiens miR-4662b
aaagauggacaauuggcuaaau

SEQ ID NO: 1230 - RNA, 24 nt, Artificial sequence
  >hsa-miR-4663 MIMAT0019735 Homo sapiens miR-4663
agcugagcuccauggacgugcagu

SEQ ID NO: 1231 - RNA, 22 nt, Artificial sequence
  >hsa-miR-4664-3p MIMAT0019738 Homo sapiens miR-4664-3p
cuuccggucugugagccccguc

SEQ ID NO: 1232 - RNA, 22 nt, Artificial sequence
  >hsa-miR-4664-5p MIMAT0019737 Homo sapiens miR-4664-5p
uggggugcccacuccgcaaguu

SEQ ID NO: 1233 - RNA, 26 nt, Artificial sequence
  >hsa-miR-4665-3p MIMAT0019740 Homo sapiens miR-4665-3p
cucggccgcggcgcguagcccccgcc

SEQ ID NO: 1234 - RNA, 23 nt, Artificial sequence
  >hsa-miR-4665-5p MIMAT0019739 Homo sapiens miR-4665-5p
cugggggacgcgugagcgcgagc

SEQ ID NO: 1235 - RNA, 21 nt, Artificial sequence
  >hsa-miR-4666a-3p MIMAT0019742 Homo sapiens miR-4666a-3p
cauacaaucugacauguauuu

SEQ ID NO: 1236 - RNA, 21 nt, Artificial sequence
  >hsa-miR-4666a-5p MIMAT0019741 Homo sapiens miR-4666a-5p
auacaugucagauuguaugcc

SEQ ID NO: 1237 - RNA, 23 nt, Artificial sequence
  >hsa-miR-4666b MIMAT0022485 Homo sapiens miR-4666b
uugcaugucagauuguaauuccc

SEQ ID NO: 1238 - RNA, 21 nt, Artificial sequence
  >hsa-miR-4667-3p MIMAT0019744 Homo sapiens miR-4667-3p
ucccuccuucuguccccacag

SEQ ID NO: 1239 - RNA, 22 nt, Artificial sequence
  >hsa-miR-4667-5p MIMAT0019743 Homo sapiens miR-4667-5p
acuggggagcagaaggagaacc

SEQ ID NO: 1240 - RNA, 23 nt, Artificial sequence
  >hsa-miR-4668-3p MIMAT0019746 Homo sapiens miR-4668-3p
gaaaauccuuuuuguuuuuccag

SEQ ID NO: 1241 - RNA, 23 nt, Artificial sequence
  >hsa-miR-4668-5p MIMAT0019745 Homo sapiens miR-4668-5p
agggaaaaaaaaaaggauuuguc

SEQ ID NO: 1242 - RNA, 22 nt, Artificial sequence
  >hsa-miR-4669 MIMAT0019749 Homo sapiens miR-4669
uguguccgggaaguggaggagg

SEQ ID NO: 1243 - RNA, 22 nt, Artificial sequence
  >hsa-miR-4670-3p MIMAT0019751 Homo sapiens miR-4670-3p
ugaaguuacaucauggucgcuu

SEQ ID NO: 1244 - RNA, 22 nt, Artificial sequence
  >hsa-miR-4670-5p MIMAT0019750 Homo sapiens miR-4670-5p
aagcgaccaugauguaacuuca

SEQ ID NO: 1245 - RNA, 21 nt, Artificial sequence
  >hsa-miR-4671-3p MIMAT0019753 Homo sapiens miR-4671-3p
uuagugcauagucuuuggucu

SEQ ID NO: 1246 - RNA, 22 nt, Artificial sequence
  >hsa-miR-4671-5p MIMAT0019752 Homo sapiens miR-4671-5p
accgaagacugugcgcuaaucu

SEQ ID NO: 1247 - RNA, 21 nt, Artificial sequence
  >hsa-miR-4672 MIMAT0019754 Homo sapiens miR-4672
uuacacagcuggacagaggca

SEQ ID NO: 1248 - RNA, 22 nt, Artificial sequence
  >hsa-miR-4673 MIMAT0019755 Homo sapiens miR-4673
uccaggcaggagccggacugga

SEQ ID NO: 1249 - RNA, 21 nt, Artificial sequence
  >hsa-miR-4674 MIMAT0019756 Homo sapiens miR-4674
cugggcucgggacgcgcggcu

SEQ ID NO: 1250 - RNA, 22 nt, Artificial sequence
  >hsa-miR-4675 MIMAT0019757 Homo sapiens miR-4675
ggggcugugauugaccagcagg

SEQ ID NO: 1251 - RNA, 22 nt, Artificial sequence
  >hsa-miR-4676-3p MIMAT0019759 Homo sapiens miR-4676-3p
cacuguuucaccacuggcucuu

SEQ ID NO: 1252 - RNA, 21 nt, Artificial sequence
  >hsa-miR-4676-5p MIMAT0019758 Homo sapiens miR-4676-5p
gagccaguggugagacaguga

SEQ ID NO: 1253 - RNA, 22 nt, Artificial sequence
  >hsa-miR-4677-3p MIMAT0019761 Homo sapiens miR-4677-3p
ucugugagaccaaagaacuacu

SEQ ID NO: 1254 - RNA, 22 nt, Artificial sequence
  >hsa-miR-4677-5p MIMAT0019760 Homo sapiens miR-4677-5p
uuguucuuuggucuuucagcca

SEQ ID NO: 1255 - RNA, 22 nt, Artificial sequence
  >hsa-miR-4678 MIMAT0019762 Homo sapiens miR-4678
aagguauuguucagacuuauga

SEQ ID NO: 1256 - RNA, 22 nt, Artificial sequence
  >hsa-miR-4679 MIMAT0019763 Homo sapiens miR-4679
ucugugauagagauucuuugcu

SEQ ID NO: 1257 - RNA, 21 nt, Artificial sequence
  >hsa-miR-4680-3p MIMAT0019765 Homo sapiens miR-4680-3p
ucugaauuguaagaguuguua

SEQ ID NO: 1258 - RNA, 23 nt, Artificial sequence
  >hsa-miR-4680-5p MIMAT0019764 Homo sapiens miR-4680-5p
agaacucuugcagucuuagaugu

SEQ ID NO: 1259 - RNA, 22 nt, Artificial sequence
  >hsa-miR-4681 MIMAT0019766 Homo sapiens miR-4681
aacgggaaugcaggcuguaucu

SEQ ID NO: 1260 - RNA, 23 nt, Artificial sequence
  >hsa-miR-4682 MIMAT0019767 Homo sapiens miR-4682
ucugaguuccuggagccuggucu

SEQ ID NO: 1261 - RNA, 23 nt, Artificial sequence
  >hsa-miR-4683 MIMAT0019768 Homo sapiens miR-4683
uggagauccagugcucgcccgau

SEQ ID NO: 1262 - RNA, 22 nt, Artificial sequence
  >hsa-miR-4684-3p MIMAT0019770 Homo sapiens miR-4684-3p
uguugcaagucgguggagacgu

SEQ ID NO: 1263 - RNA, 22 nt, Artificial sequence
  >hsa-miR-4684-5p MIMAT0019769 Homo sapiens miR-4684-5p
cucucuacugacuugcaacaua

SEQ ID NO: 1264 - RNA, 22 nt, Artificial sequence
  >hsa-miR-4685-3p MIMAT0019772 Homo sapiens miR-4685-3p
ucucccuuccugcccuggcuag

SEQ ID NO: 1265 - RNA, 26 nt, Artificial sequence
  >hsa-miR-4685-5p MIMAT0019771 Homo sapiens miR-4685-5p
cccagggcuuggaguggggcaagguu

SEQ ID NO: 1266 - RNA, 23 nt, Artificial sequence
  >hsa-miR-4686 MIMAT0019773 Homo sapiens miR-4686
uaucugcugggcuuucugguguu

SEQ ID NO: 1267 - RNA, 21 nt, Artificial sequence
  >hsa-miR-4687-3p MIMAT0019775 Homo sapiens miR-4687-3p
uggcuguuggagggggcaggc

SEQ ID NO: 1268 - RNA, 22 nt, Artificial sequence
  >hsa-miR-4687-5p MIMAT0019774 Homo sapiens miR-4687-5p
cagcccuccucccgcacccaaa

SEQ ID NO: 1269 - RNA, 22 nt, Artificial sequence
  >hsa-miR-4688 MIMAT0019777 Homo sapiens miR-4688
uaggggcagcagaggaccuggg

SEQ ID NO: 1270 - RNA, 22 nt, Artificial sequence
  >hsa-miR-4689 MIMAT0019778 Homo sapiens miR-4689
uugaggagacauggugggggcc

SEQ ID NO: 1271 - RNA, 21 nt, Artificial sequence
  >hsa-miR-4690-3p MIMAT0019780 Homo sapiens miR-4690-3p
gcagcccagcugaggccucug

SEQ ID NO: 1272 - RNA, 22 nt, Artificial sequence
  >hsa-miR-4690-5p MIMAT0019779 Homo sapiens miR-4690-5p
gagcaggcgaggcugggcugaa

SEQ ID NO: 1273 - RNA, 23 nt, Artificial sequence
  >hsa-miR-4691-3p MIMAT0019782 Homo sapiens miR-4691-3p
ccagccacggacugagagugcau

SEQ ID NO: 1274 - RNA, 23 nt, Artificial sequence
  >hsa-miR-4691-5p MIMAT0019781 Homo sapiens miR-4691-5p
guccuccaggccaugagcugcgg

SEQ ID NO: 1275 - RNA, 22 nt, Artificial sequence
  >hsa-miR-4692 MIMAT0019783 Homo sapiens miR-4692
ucaggcaguguggguaucagau

SEQ ID NO: 1276 - RNA, 23 nt, Artificial sequence
  >hsa-miR-4693-3p MIMAT0019785 Homo sapiens miR-4693-3p
ugagaguggaauucacaguauuu

SEQ ID NO: 1277 - RNA, 23 nt, Artificial sequence
  >hsa-miR-4693-5p MIMAT0019784 Homo sapiens miR-4693-5p
auacugugaauuucacugucaca

SEQ ID NO: 1278 - RNA, 21 nt, Artificial sequence
  >hsa-miR-4694-3p MIMAT0019787 Homo sapiens miR-4694-3p
caaauggacaggauaacaccu

SEQ ID NO: 1279 - RNA, 22 nt, Artificial sequence
  >hsa-miR-4694-5p MIMAT0019786 Homo sapiens miR-4694-5p
agguguuauccuauccauuugc

SEQ ID NO: 1280 - RNA, 22 nt, Artificial sequence
  >hsa-miR-4695-3p MIMAT0019789 Homo sapiens miR-4695-3p
ugaucucaccgcugccuccuuc

SEQ ID NO: 1281 - RNA, 22 nt, Artificial sequence
  >hsa-miR-4695-5p MIMAT0019788 Homo sapiens miR-4695-5p
caggaggcagugggcgagcagg

SEQ ID NO: 1282 - RNA, 22 nt, Artificial sequence
  >hsa-miR-4696 MIMAT0019790 Homo sapiens miR-4696
ugcaagacggauacugucaucu

SEQ ID NO: 1283 - RNA, 24 nt, Artificial sequence
  >hsa-miR-4697-3p MIMAT0019792 Homo sapiens miR-4697-3p
ugucagugacuccugccccuuggu

SEQ ID NO: 1284 - RNA, 22 nt, Artificial sequence
  >hsa-miR-4697-5p MIMAT0019791 Homo sapiens miR-4697-5p
agggggcgcagucacugacgug

SEQ ID NO: 1285 - RNA, 23 nt, Artificial sequence
  >hsa-miR-4698 MIMAT0019793 Homo sapiens miR-4698
ucaaaauguagaggaagacccca

SEQ ID NO: 1286 - RNA, 22 nt, Artificial sequence
  >hsa-miR-4699-3p MIMAT0019795 Homo sapiens miR-4699-3p
aauuuacucugcaaucuucucc

SEQ ID NO: 1287 - RNA, 22 nt, Artificial sequence
  >hsa-miR-4699-5p MIMAT0019794 Homo sapiens miR-4699-5p
agaagauugcagaguaaguucc

SEQ ID NO: 1288 - RNA, 26 nt, Artificial sequence
  >hsa-miR-4700-3p MIMAT0019797 Homo sapiens miR-4700-3p
cacaggacugacuccucaccccagug

SEQ ID NO: 1289 - RNA, 22 nt, Artificial sequence
  >hsa-miR-4700-5p MIMAT0019796 Homo sapiens miR-4700-5p
ucuggggaugaggacagugugu

SEQ ID NO: 1290 - RNA, 20 nt, Artificial sequence
  >hsa-miR-4701-3p MIMAT0019799 Homo sapiens miR-4701-3p
augggugauggguguggugu

SEQ ID NO: 1291 - RNA, 22 nt, Artificial sequence
  >hsa-miR-4701-5p MIMAT0019798 Homo sapiens miR-4701-5p
uuggccaccacaccuaccccuu

SEQ ID NO: 1292 - RNA, 22 nt, Artificial sequence
  >hsa-miR-4703-3p MIMAT0019802 Homo sapiens miR-4703-3p
uguaguuguauuguauugccac

SEQ ID NO: 1293 - RNA, 23 nt, Artificial sequence
  >hsa-miR-4703-5p MIMAT0019801 Homo sapiens miR-4703-5p
uagcaauacaguacaaauauagu

SEQ ID NO: 1294 - RNA, 22 nt, Artificial sequence
  >hsa-miR-4704-3p MIMAT0019804 Homo sapiens miR-4704-3p
ucagucacauaucuagugucua

SEQ ID NO: 1295 - RNA, 22 nt, Artificial sequence
  >hsa-miR-4704-5p MIMAT0019803 Homo sapiens miR-4704-5p
gacacuaggcaugugagugauu

SEQ ID NO: 1296 - RNA, 22 nt, Artificial sequence
  >hsa-miR-4705 MIMAT0019805 Homo sapiens miR-4705
ucaaucacuugguaauugcugu

SEQ ID NO: 1297 - RNA, 25 nt, Artificial sequence
  >hsa-miR-4706 MIMAT0019806 Homo sapiens miR-4706
agcggggaggaagugggcgcugcuu

SEQ ID NO: 1298 - RNA, 22 nt, Artificial sequence
  >hsa-miR-4707-3p MIMAT0019808 Homo sapiens miR-4707-3p
agcccgccccagccgagguucu

SEQ ID NO: 1299 - RNA, 23 nt, Artificial sequence
  >hsa-miR-4707-5p MIMAT0019807 Homo sapiens miR-4707-5p
gccccggcgcgggcggguucugg

SEQ ID NO: 1300 - RNA, 22 nt, Artificial sequence
  >hsa-miR-4708-3p MIMAT0019810 Homo sapiens miR-4708-3p
agcaaggcggcaucucucugau

SEQ ID NO: 1301 - RNA, 21 nt, Artificial sequence
  >hsa-miR-4708-5p MIMAT0019809 Homo sapiens miR-4708-5p
agagaugccgccuugcuccuu

SEQ ID NO: 1302 - RNA, 23 nt, Artificial sequence
  >hsa-miR-4709-3p MIMAT0019812 Homo sapiens miR-4709-3p
uugaagaggaggugcucuguagc

SEQ ID NO: 1303 - RNA, 22 nt, Artificial sequence
  >hsa-miR-4709-5p MIMAT0019811 Homo sapiens miR-4709-5p
acaacagugacuugcucuccaa

SEQ ID NO: 1304 - RNA, 18 nt, Artificial sequence
  >hsa-miR-4710 MIMAT0019815 Homo sapiens miR-4710
gggugagggcaggugguu

SEQ ID NO: 1305 - RNA, 18 nt, Artificial sequence
  >hsa-miR-4711-3p MIMAT0019817 Homo sapiens miR-4711-3p
cgugucuucuggcuugau

SEQ ID NO: 1306 - RNA, 23 nt, Artificial sequence
  >hsa-miR-4711-5p MIMAT0019816 Homo sapiens miR-4711-5p
ugcaucaggccagaagacaugag

SEQ ID NO: 1307 - RNA, 21 nt, Artificial sequence
  >hsa-miR-4712-3p MIMAT0019819 Homo sapiens miR-4712-3p
aaugagagaccuguacuguau

SEQ ID NO: 1308 - RNA, 22 nt, Artificial sequence
  >hsa-miR-4712-5p MIMAT0019818 Homo sapiens miR-4712-5p
uccaguacaggucucucauuuc

SEQ ID NO: 1309 - RNA, 22 nt, Artificial sequence
  >hsa-miR-4713-3p MIMAT0019821 Homo sapiens miR-4713-3p
ugggauccagacagugggagaa

SEQ ID NO: 1310 - RNA, 22 nt, Artificial sequence
  >hsa-miR-4713-5p MIMAT0019820 Homo sapiens miR-4713-5p
uucucccacuaccaggcuccca

SEQ ID NO: 1311 - RNA, 22 nt, Artificial sequence
  >hsa-miR-4714-3p MIMAT0019823 Homo sapiens miR-4714-3p
ccaaccuagguggucagaguug

SEQ ID NO: 1312 - RNA, 22 nt, Artificial sequence
  >hsa-miR-4714-5p MIMAT0019822 Homo sapiens miR-4714-5p
aacucugaccccuuagguugau

SEQ ID NO: 1313 - RNA, 23 nt, Artificial sequence
  >hsa-miR-4715-3p MIMAT0019825 Homo sapiens miR-4715-3p
gugccaccuuaacugcagccaau

SEQ ID NO: 1314 - RNA, 22 nt, Artificial sequence
  >hsa-miR-4715-5p MIMAT0019824 Homo sapiens miR-4715-5p
aaguuggcugcaguuaaggugg

SEQ ID NO: 1315 - RNA, 22 nt, Artificial sequence
  >hsa-miR-4716-3p MIMAT0019827 Homo sapiens miR-4716-3p
aagggggaaggaaacauggaga

SEQ ID NO: 1316 - RNA, 22 nt, Artificial sequence
  >hsa-miR-4716-5p MIMAT0019826 Homo sapiens miR-4716-5p
uccauguuuccuucccccuucu

SEQ ID NO: 1317 - RNA, 21 nt, Artificial sequence
  >hsa-miR-4717-3p MIMAT0019830 Homo sapiens miR-4717-3p
acacauggguggcuguggccu

SEQ ID NO: 1318 - RNA, 22 nt, Artificial sequence
  >hsa-miR-4717-5p MIMAT0019829 Homo sapiens miR-4717-5p
uaggccacagccacccaugugu

SEQ ID NO: 1319 - RNA, 21 nt, Artificial sequence
  >hsa-miR-4718 MIMAT0019831 Homo sapiens miR-4718
agcuguaccugaaaccaagca

SEQ ID NO: 1320 - RNA, 22 nt, Artificial sequence
  >hsa-miR-4719 MIMAT0019832 Homo sapiens miR-4719
ucacaaaucuauaauaugcagg

SEQ ID NO: 1321 - RNA, 21 nt, Artificial sequence
  >hsa-miR-4720-3p MIMAT0019834 Homo sapiens miR-4720-3p
ugcuuaaguuguaccaaguau

SEQ ID NO: 1322 - RNA, 22 nt, Artificial sequence
  >hsa-miR-4720-5p MIMAT0019833 Homo sapiens miR-4720-5p
ccuggcauauuugguauaacuu

SEQ ID NO: 1323 - RNA, 22 nt, Artificial sequence
  >hsa-miR-4721 MIMAT0019835 Homo sapiens miR-4721
ugagggcuccaggugacggugg

SEQ ID NO: 1324 - RNA, 22 nt, Artificial sequence
  >hsa-miR-4722-3p MIMAT0019837 Homo sapiens miR-4722-3p
accugccagcaccucccugcag

SEQ ID NO: 1325 - RNA, 23 nt, Artificial sequence
  >hsa-miR-4722-5p MIMAT0019836 Homo sapiens miR-4722-5p
ggcaggagggcugugccagguug

SEQ ID NO: 1326 - RNA, 22 nt, Artificial sequence
  >hsa-miR-4723-3p MIMAT0019839 Homo sapiens miR-4723-3p
cccucucuggcuccuccccaaa

SEQ ID NO: 1327 - RNA, 24 nt, Artificial sequence
  >hsa-miR-4723-5p MIMAT0019838 Homo sapiens miR-4723-5p
ugggggagccaugagauaagagca

SEQ ID NO: 1328 - RNA, 21 nt, Artificial sequence
  >hsa-miR-4724-3p MIMAT0019842 Homo sapiens miR-4724-3p
guaccuucugguucagcuagu

SEQ ID NO: 1329 - RNA, 23 nt, Artificial sequence
  >hsa-miR-4724-5p MIMAT0019841 Homo sapiens miR-4724-5p
aacugaaccaggagugagcuucg

SEQ ID NO: 1330 - RNA, 22 nt, Artificial sequence
  >hsa-miR-4725-3p MIMAT0019844 Homo sapiens miR-4725-3p
uggggaaggcgucagugucggg

SEQ ID NO: 1331 - RNA, 21 nt, Artificial sequence
  >hsa-miR-4725-5p MIMAT0019843 Homo sapiens miR-4725-5p
agacccugcagccuucccacc

SEQ ID NO: 1332 - RNA, 22 nt, Artificial sequence
  >hsa-miR-4726-3p MIMAT0019846 Homo sapiens miR-4726-3p
acccagguucccucuggccgca

SEQ ID NO: 1333 - RNA, 23 nt, Artificial sequence
  >hsa-miR-4726-5p MIMAT0019845 Homo sapiens miR-4726-5p
agggccagaggagccuggagugg

SEQ ID NO: 1334 - RNA, 22 nt, Artificial sequence
  >hsa-miR-4727-3p MIMAT0019848 Homo sapiens miR-4727-3p
auagugggaagcuggcagauuc

SEQ ID NO: 1335 - RNA, 21 nt, Artificial sequence
  >hsa-miR-4727-5p MIMAT0019847 Homo sapiens miR-4727-5p
aucugccagcuuccacagugg

SEQ ID NO: 1336 - RNA, 25 nt, Artificial sequence
  >hsa-miR-4728-3p MIMAT0019850 Homo sapiens miR-4728-3p
caugcugaccucccuccugccccag

SEQ ID NO: 1337 - RNA, 23 nt, Artificial sequence
  >hsa-miR-4728-5p MIMAT0019849 Homo sapiens miR-4728-5p
ugggaggggagaggcagcaagca

SEQ ID NO: 1338 - RNA, 22 nt, Artificial sequence
  >hsa-miR-4729 MIMAT0019851 Homo sapiens miR-4729
ucauuuaucuguugggaagcua

SEQ ID NO: 1339 - RNA, 23 nt, Artificial sequence
  >hsa-miR-4730 MIMAT0019852 Homo sapiens miR-4730
cuggcggagcccauuccaugcca

SEQ ID NO: 1340 - RNA, 22 nt, Artificial sequence
  >hsa-miR-4731-3p MIMAT0019854 Homo sapiens miR-4731-3p
cacacaaguggcccccaacacu

SEQ ID NO: 1341 - RNA, 22 nt, Artificial sequence
  >hsa-miR-4731-5p MIMAT0019853 Homo sapiens miR-4731-5p
ugcugggggccacaugagugug

SEQ ID NO: 1342 - RNA, 21 nt, Artificial sequence
  >hsa-miR-4732-3p MIMAT0019856 Homo sapiens miR-4732-3p
gcccugaccuguccuguucug

SEQ ID NO: 1343 - RNA, 23 nt, Artificial sequence
  >hsa-miR-4732-5p MIMAT0019855 Homo sapiens miR-4732-5p
uguagagcagggagcaggaagcu

SEQ ID NO: 1344 - RNA, 22 nt, Artificial sequence
  >hsa-miR-4733-3p MIMAT0019858 Homo sapiens miR-4733-3p
ccaccaggucuagcauugggau

SEQ ID NO: 1345 - RNA, 22 nt, Artificial sequence
  >hsa-miR-4733-5p MIMAT0019857 Homo sapiens miR-4733-5p
aaucccaaugcuagacccggug

SEQ ID NO: 1346 - RNA, 22 nt, Artificial sequence
  >hsa-miR-4734 MIMAT0019859 Homo sapiens miR-4734
gcugcgggcugcggucagggcg

SEQ ID NO: 1347 - RNA, 21 nt, Artificial sequence
  >hsa-miR-4735-3p MIMAT0019861 Homo sapiens miR-4735-3p
aaaggugcucaaauuagacau

SEQ ID NO: 1348 - RNA, 22 nt, Artificial sequence
  >hsa-miR-4735-5p MIMAT0019860 Homo sapiens miR-4735-5p
ccuaauuugaacaccuucggua

SEQ ID NO: 1349 - RNA, 19 nt, Artificial sequence
  >hsa-miR-4736 MIMAT0019862 Homo sapiens miR-4736
aggcagguuaucugggcug

SEQ ID NO: 1350 - RNA, 20 nt, Artificial sequence
  >hsa-miR-4737 MIMAT0019863 Homo sapiens miR-4737
augcgaggaugcugacagug

SEQ ID NO: 1351 - RNA, 22 nt, Artificial sequence
  >hsa-miR-4738-3p MIMAT0019867 Homo sapiens miR-4738-3p
ugaaacuggagcgccuggagga

SEQ ID NO: 1352 - RNA, 22 nt, Artificial sequence
  >hsa-miR-4738-5p MIMAT0019866 Homo sapiens miR-4738-5p
accagcgcguuuucaguuucau

SEQ ID NO: 1353 - RNA, 25 nt, Artificial sequence
  >hsa-miR-4739 MIMAT0019868 Homo sapiens miR-4739
aagggaggaggagcggaggggcccu

SEQ ID NO: 1354 - RNA, 22 nt, Artificial sequence
  >hsa-miR-4740-3p MIMAT0019870 Homo sapiens miR-4740-3p
gcccgagaggauccgucccugc

SEQ ID NO: 1355 - RNA, 22 nt, Artificial sequence
  >hsa-miR-4740-5p MIMAT0019869 Homo sapiens miR-4740-5p
aggacugauccucucgggcagg

SEQ ID NO: 1356 - RNA, 23 nt, Artificial sequence
  >hsa-miR-4741 MIMAT0019871 Homo sapiens miR-4741
cgggcuguccggaggggucggcu

SEQ ID NO: 1357 - RNA, 23 nt, Artificial sequence
  >hsa-miR-4742-3p MIMAT0019873 Homo sapiens miR-4742-3p
ucuguauucuccuuugccugcag

SEQ ID NO: 1358 - RNA, 23 nt, Artificial sequence
  >hsa-miR-4742-5p MIMAT0019872 Homo sapiens miR-4742-5p
ucaggcaaagggauauuuacaga

SEQ ID NO: 1359 - RNA, 21 nt, Artificial sequence
  >hsa-miR-4743-3p MIMAT0022978 Homo sapiens miR-4743-3p
uuucugucuuuucugguccag

SEQ ID NO: 1360 - RNA, 23 nt, Artificial sequence
  >hsa-miR-4743-5p MIMAT0019874 Homo sapiens miR-4743-5p
uggccggaugggacaggaggcau

SEQ ID NO: 1361 - RNA, 23 nt, Artificial sequence
  >hsa-miR-4744 MIMAT0019875 Homo sapiens miR-4744
ucuaaagacuagacuucgcuaug

SEQ ID NO: 1362 - RNA, 23 nt, Artificial sequence
  >hsa-miR-4745-3p MIMAT0019879 Homo sapiens miR-4745-3p
uggcccggcgacgucucacgguc

SEQ ID NO: 1363 - RNA, 23 nt, Artificial sequence
  >hsa-miR-4745-5p MIMAT0019878 Homo sapiens miR-4745-5p
ugaguggggcucccgggacggcg

SEQ ID NO: 1364 - RNA, 21 nt, Artificial sequence
  >hsa-miR-4746-3p MIMAT0019881 Homo sapiens miR-4746-3p
agcggugcuccugcgggccga

SEQ ID NO: 1365 - RNA, 23 nt, Artificial sequence
  >hsa-miR-4746-5p MIMAT0019880 Homo sapiens miR-4746-5p
ccggucccaggagaaccugcaga

SEQ ID NO: 1366 - RNA, 22 nt, Artificial sequence
  >hsa-miR-4747-3p MIMAT0019883 Homo sapiens miR-4747-3p
aaggcccgggcuuuccucccag

SEQ ID NO: 1367 - RNA, 22 nt, Artificial sequence
  >hsa-miR-4747-5p MIMAT0019882 Homo sapiens miR-4747-5p
agggaaggaggcuuggucuuag

SEQ ID NO: 1368 - RNA, 21 nt, Artificial sequence
  >hsa-miR-4748 MIMAT0019884 Homo sapiens miR-4748
gagguuuggggaggauuugcu

SEQ ID NO: 1369 - RNA, 20 nt, Artificial sequence
  >hsa-miR-4749-3p MIMAT0019886 Homo sapiens miR-4749-3p
cgccccuccugcccccacag

SEQ ID NO: 1370 - RNA, 22 nt, Artificial sequence
  >hsa-miR-4749-5p MIMAT0019885 Homo sapiens miR-4749-5p
ugcggggacaggccagggcauc

SEQ ID NO: 1371 - RNA, 22 nt, Artificial sequence
  >hsa-miR-4750-3p MIMAT0022979 Homo sapiens miR-4750-3p
ccugacccacccccucccgcag

SEQ ID NO: 1372 - RNA, 22 nt, Artificial sequence
  >hsa-miR-4750-5p MIMAT0019887 Homo sapiens miR-4750-5p
cucgggcggaggugguugagug

SEQ ID NO: 1373 - RNA, 24 nt, Artificial sequence
  >hsa-miR-4751 MIMAT0019888 Homo sapiens miR-4751
agaggacccguagcugcuagaagg

SEQ ID NO: 1374 - RNA, 22 nt, Artificial sequence
  >hsa-miR-4752 MIMAT0019889 Homo sapiens miR-4752
uuguggaucucaaggaugugcu

SEQ ID NO: 1375 - RNA, 22 nt, Artificial sequence
  >hsa-miR-4753-3p MIMAT0019891 Homo sapiens miR-4753-3p
uucucuuucuuuagccuugugu

SEQ ID NO: 1376 - RNA, 22 nt, Artificial sequence
  >hsa-miR-4753-5p MIMAT0019890 Homo sapiens miR-4753-5p
caaggccaaaggaagagaacag

SEQ ID NO: 1377 - RNA, 23 nt, Artificial sequence
  >hsa-miR-4754 MIMAT0019894 Homo sapiens miR-4754
augcggaccuggguuagcggagu

SEQ ID NO: 1378 - RNA, 22 nt, Artificial sequence
  >hsa-miR-4755-3p MIMAT0019896 Homo sapiens miR-4755-3p
agccaggcucugaagggaaagu

SEQ ID NO: 1379 - RNA, 22 nt, Artificial sequence
  >hsa-miR-4755-5p MIMAT0019895 Homo sapiens miR-4755-5p
uuucccuucagagccuggcuuu

SEQ ID NO: 1380 - RNA, 22 nt, Artificial sequence
  >hsa-miR-4756-3p MIMAT0019900 Homo sapiens miR-4756-3p
ccagagaugguugccuuccuau

SEQ ID NO: 1381 - RNA, 23 nt, Artificial sequence
  >hsa-miR-4756-5p MIMAT0019899 Homo sapiens miR-4756-5p
cagggaggcgcucacucucugcu

SEQ ID NO: 1382 - RNA, 22 nt, Artificial sequence
  >hsa-miR-4757-3p MIMAT0019902 Homo sapiens miR-4757-3p
caugacgucacagaggcuucgc

SEQ ID NO: 1383 - RNA, 23 nt, Artificial sequence
  >hsa-miR-4757-5p MIMAT0019901 Homo sapiens miR-4757-5p
aggccucugugacgucacggugu

SEQ ID NO: 1384 - RNA, 23 nt, Artificial sequence
  >hsa-miR-4758-3p MIMAT0019904 Homo sapiens miR-4758-3p
ugccccaccugcugaccacccuc

SEQ ID NO: 1385 - RNA, 23 nt, Artificial sequence
  >hsa-miR-4758-5p MIMAT0019903 Homo sapiens miR-4758-5p
gugagugggagccgguggggcug

SEQ ID NO: 1386 - RNA, 21 nt, Artificial sequence
  >hsa-miR-4759 MIMAT0019905 Homo sapiens miR-4759
uaggacuagauguuggaauua

SEQ ID NO: 1387 - RNA, 22 nt, Artificial sequence
  >hsa-miR-4760-3p MIMAT0019907 Homo sapiens miR-4760-3p
aaauucauguucaaucuaaacc

SEQ ID NO: 1388 - RNA, 22 nt, Artificial sequence
  >hsa-miR-4760-5p MIMAT0019906 Homo sapiens miR-4760-5p
uuuagauugaacaugaaguuag

SEQ ID NO: 1389 - RNA, 21 nt, Artificial sequence
  >hsa-miR-4761-3p MIMAT0019909 Homo sapiens miR-4761-3p
gagggcaugcgcacuuugucc

SEQ ID NO: 1390 - RNA, 21 nt, Artificial sequence
  >hsa-miR-4761-5p MIMAT0019908 Homo sapiens miR-4761-5p
acaaggugugcaugccugacc

SEQ ID NO: 1391 - RNA, 22 nt, Artificial sequence
  >hsa-miR-4762-3p MIMAT0019911 Homo sapiens miR-4762-3p
cuucugaucaagauuuguggug

SEQ ID NO: 1392 - RNA, 21 nt, Artificial sequence
  >hsa-miR-4762-5p MIMAT0019910 Homo sapiens miR-4762-5p
ccaaaucuugaucagaagccu

SEQ ID NO: 1393 - RNA, 24 nt, Artificial sequence
  >hsa-miR-4763-3p MIMAT0019913 Homo sapiens miR-4763-3p
aggcaggggcuggugcugggcggg

SEQ ID NO: 1394 - RNA, 21 nt, Artificial sequence
  >hsa-miR-4763-5p MIMAT0019912 Homo sapiens miR-4763-5p
cgccugcccagcccuccugcu

SEQ ID NO: 1395 - RNA, 22 nt, Artificial sequence
  >hsa-miR-4764-3p MIMAT0019915 Homo sapiens miR-4764-3p
uuaacuccuuucacacccaugg

SEQ ID NO: 1396 - RNA, 21 nt, Artificial sequence
  >hsa-miR-4764-5p MIMAT0019914 Homo sapiens miR-4764-5p
uggauguggaaggaguuaucu

SEQ ID NO: 1397 - RNA, 22 nt, Artificial sequence
  >hsa-miR-4765 MIMAT0019916 Homo sapiens miR-4765
ugagugauugauagcuauguuc

SEQ ID NO: 1398 - RNA, 21 nt, Artificial sequence
  >hsa-miR-4766-3p MIMAT0019918 Homo sapiens miR-4766-3p
auagcaauugcucuuuuggaa

SEQ ID NO: 1399 - RNA, 21 nt, Artificial sequence
  >hsa-miR-4766-5p MIMAT0019917 Homo sapiens miR-4766-5p
ucugaaagagcaguugguguu

SEQ ID NO: 1400 - RNA, 23 nt, Artificial sequence
  >hsa-miR-4767 MIMAT0019919 Homo sapiens miR-4767
cgcgggcgcuccuggccgccgcc

SEQ ID NO: 1401 - RNA, 20 nt, Artificial sequence
  >hsa-miR-4768-3p MIMAT0019921 Homo sapiens miR-4768-3p
ccaggagauccagagagaau

SEQ ID NO: 1402 - RNA, 22 nt, Artificial sequence
  >hsa-miR-4768-5p MIMAT0019920 Homo sapiens miR-4768-5p
auucucucuggaucccauggau

SEQ ID NO: 1403 - RNA, 22 nt, Artificial sequence
  >hsa-miR-4769-3p MIMAT0019923 Homo sapiens miR-4769-3p
ucugccauccucccuccccuac

SEQ ID NO: 1404 - RNA, 24 nt, Artificial sequence
  >hsa-miR-4769-5p MIMAT0019922 Homo sapiens miR-4769-5p
ggugggauggagagaagguaugag

SEQ ID NO: 1405 - RNA, 18 nt, Artificial sequence
  >hsa-miR-4770 MIMAT0019924 Homo sapiens miR-4770
ugagaugacacuguagcu

SEQ ID NO: 1406 - RNA, 21 nt, Artificial sequence
  >hsa-miR-4771 MIMAT0019925 Homo sapiens miR-4771
agcagacuugaccuacaauua

SEQ ID NO: 1407 - RNA, 22 nt, Artificial sequence
  >hsa-miR-4772-3p MIMAT0019927 Homo sapiens miR-4772-3p
ccugcaacuuugccugaucaga

SEQ ID NO: 1408 - RNA, 22 nt, Artificial sequence
  >hsa-miR-4772-5p MIMAT0019926 Homo sapiens miR-4772-5p
ugaucaggcaaaauugcagacu

SEQ ID NO: 1409 - RNA, 22 nt, Artificial sequence
  >hsa-miR-4773 MIMAT0019928 Homo sapiens miR-4773
cagaacaggagcauagaaaggc

SEQ ID NO: 1410 - RNA, 21 nt, Artificial sequence
  >hsa-miR-4774-3p MIMAT0019930 Homo sapiens miR-4774-3p
auugccuaacaugugccagaa

SEQ ID NO: 1411 - RNA, 22 nt, Artificial sequence
  >hsa-miR-4774-5p MIMAT0019929 Homo sapiens miR-4774-5p
ucugguauguaguagguaauaa

SEQ ID NO: 1412 - RNA, 22 nt, Artificial sequence
  >hsa-miR-4775 MIMAT0019931 Homo sapiens miR-4775
uuaauuuuuuguuucggucacu

SEQ ID NO: 1413 - RNA, 23 nt, Artificial sequence
  >hsa-miR-4776-3p MIMAT0019933 Homo sapiens miR-4776-3p
cuugccauccugguccacugcau

SEQ ID NO: 1414 - RNA, 22 nt, Artificial sequence
  >hsa-miR-4776-5p MIMAT0019932 Homo sapiens miR-4776-5p
guggaccaggauggcaagggcu

SEQ ID NO: 1415 - RNA, 22 nt, Artificial sequence
  >hsa-miR-4777-3p MIMAT0019935 Homo sapiens miR-4777-3p
auaccucaucuagaaugcugua

SEQ ID NO: 1416 - RNA, 22 nt, Artificial sequence
  >hsa-miR-4777-5p MIMAT0019934 Homo sapiens miR-4777-5p
uucuagaugagagauauauaua

SEQ ID NO: 1417 - RNA, 22 nt, Artificial sequence
  >hsa-miR-4778-3p MIMAT0019937 Homo sapiens miR-4778-3p
ucuucuuccuuugcagaguuga

SEQ ID NO: 1418 - RNA, 22 nt, Artificial sequence
  >hsa-miR-4778-5p MIMAT0019936 Homo sapiens miR-4778-5p
aauucuguaaaggaagaagagg

SEQ ID NO: 1419 - RNA, 22 nt, Artificial sequence
  >hsa-miR-4779 MIMAT0019938 Homo sapiens miR-4779
uaggagggaauaguaaaagcag

SEQ ID NO: 1420 - RNA, 22 nt, Artificial sequence
  >hsa-miR-4780 MIMAT0019939 Homo sapiens miR-4780
acccuugagccugaucccuagc

SEQ ID NO: 1421 - RNA, 22 nt, Artificial sequence
  >hsa-miR-4781-3p MIMAT0019943 Homo sapiens miR-4781-3p
aauguuggaauccucgcuagag

SEQ ID NO: 1422 - RNA, 21 nt, Artificial sequence
  >hsa-miR-4781-5p MIMAT0019942 Homo sapiens miR-4781-5p
uagcggggauuccaauauugg

SEQ ID NO: 1423 - RNA, 22 nt, Artificial sequence
  >hsa-miR-4782-3p MIMAT0019945 Homo sapiens miR-4782-3p
ugauugucuucauaucuagaac

SEQ ID NO: 1424 - RNA, 22 nt, Artificial sequence
  >hsa-miR-4782-5p MIMAT0019944 Homo sapiens miR-4782-5p
uucuggauaugaagacaaucaa

SEQ ID NO: 1425 - RNA, 23 nt, Artificial sequence
  >hsa-miR-4783-3p MIMAT0019947 Homo sapiens miR-4783-3p
ccccgguguuggggcgcgucugc

SEQ ID NO: 1426 - RNA, 21 nt, Artificial sequence
  >hsa-miR-4783-5p MIMAT0019946 Homo sapiens miR-4783-5p
ggcgcgcccagcucccgggcu

SEQ ID NO: 1427 - RNA, 20 nt, Artificial sequence
  >hsa-miR-4784 MIMAT0019948 Homo sapiens miR-4784
ugaggagaugcugggacuga

SEQ ID NO: 1428 - RNA, 21 nt, Artificial sequence
  >hsa-miR-4785 MIMAT0019949 Homo sapiens miR-4785
agagucggcgacgccgccagc

SEQ ID NO: 1429 - RNA, 22 nt, Artificial sequence
  >hsa-miR-4786-3p MIMAT0019955 Homo sapiens miR-4786-3p
ugaagccagcucuggucugggc

SEQ ID NO: 1430 - RNA, 22 nt, Artificial sequence
  >hsa-miR-4786-5p MIMAT0019954 Homo sapiens miR-4786-5p
ugagaccaggacuggaugcacc

SEQ ID NO: 1431 - RNA, 24 nt, Artificial sequence
  >hsa-miR-4787-3p MIMAT0019957 Homo sapiens miR-4787-3p
gaugcgccgcccacugccccgcgc

SEQ ID NO: 1432 - RNA, 22 nt, Artificial sequence
  >hsa-miR-4787-5p MIMAT0019956 Homo sapiens miR-4787-5p
gcggggguggcggcggcauccc

SEQ ID NO: 1433 - RNA, 22 nt, Artificial sequence
  >hsa-miR-4788 MIMAT0019958 Homo sapiens miR-4788
uuacggaccagcuaagggaggc

SEQ ID NO: 1434 - RNA, 21 nt, Artificial sequence
  >hsa-miR-4789-3p MIMAT0019960 Homo sapiens miR-4789-3p
cacacauagcagguguauaua

SEQ ID NO: 1435 - RNA, 22 nt, Artificial sequence
  >hsa-miR-4789-5p MIMAT0019959 Homo sapiens miR-4789-5p
guauacaccugauauguguaug

SEQ ID NO: 1436 - RNA, 22 nt, Artificial sequence
  >hsa-miR-4790-3p MIMAT0019962 Homo sapiens miR-4790-3p
ugaaugguaaagcgaugucaca

SEQ ID NO: 1437 - RNA, 20 nt, Artificial sequence
  >hsa-miR-4790-5p MIMAT0019961 Homo sapiens miR-4790-5p
aucgcuuuaccauucauguu

SEQ ID NO: 1438 - RNA, 18 nt, Artificial sequence
  >hsa-miR-4791 MIMAT0019963 Homo sapiens miR-4791
uggauaugaugacugaaa

SEQ ID NO: 1439 - RNA, 18 nt, Artificial sequence
  >hsa-miR-4792 MIMAT0019964 Homo sapiens miR-4792
cggugagcgcucgcuggc

SEQ ID NO: 1440 - RNA, 23 nt, Artificial sequence
  >hsa-miR-4793-3p MIMAT0019966 Homo sapiens miR-4793-3p
ucugcacugugaguuggcuggcu

SEQ ID NO: 1441 - RNA, 24 nt, Artificial sequence
  >hsa-miR-4793-5p MIMAT0019965 Homo sapiens miR-4793-5p
acauccugcuccacagggcagagg

SEQ ID NO: 1442 - RNA, 22 nt, Artificial sequence
  >hsa-miR-4794 MIMAT0019967 Homo sapiens miR-4794
ucuggcuaucucacgagacugu

SEQ ID NO: 1443 - RNA, 22 nt, Artificial sequence
  >hsa-miR-4795-3p MIMAT0019969 Homo sapiens miR-4795-3p
auauuauuagccacuucuggau

SEQ ID NO: 1444 - RNA, 21 nt, Artificial sequence
  >hsa-miR-4795-5p MIMAT0019968 Homo sapiens miR-4795-5p
agaaguggcuaauaauauuga

SEQ ID NO: 1445 - RNA, 22 nt, Artificial sequence
  >hsa-miR-4796-3p MIMAT0019971 Homo sapiens miR-4796-3p
uaaaguggcagaguauagacac

SEQ ID NO: 1446 - RNA, 22 nt, Artificial sequence
  >hsa-miR-4796-5p MIMAT0019970 Homo sapiens miR-4796-5p
ugucuauacucugucacuuuac

SEQ ID NO: 1447 - RNA, 21 nt, Artificial sequence
  >hsa-miR-4797-3p MIMAT0019973 Homo sapiens miR-4797-3p
ucucaguaaguggcacucugu

SEQ ID NO: 1448 - RNA, 21 nt, Artificial sequence
  >hsa-miR-4797-5p MIMAT0019972 Homo sapiens miR-4797-5p
gacagagugccacuuacugaa

SEQ ID NO: 1449 - RNA, 22 nt, Artificial sequence
  >hsa-miR-4798-3p MIMAT0019975 Homo sapiens miR-4798-3p
aacucacgaaguauaccgaagu

SEQ ID NO: 1450 - RNA, 22 nt, Artificial sequence
  >hsa-miR-4798-5p MIMAT0019974 Homo sapiens miR-4798-5p
uucgguauacuuugugaauugg

SEQ ID NO: 1451 - RNA, 22 nt, Artificial sequence
  >hsa-miR-4799-3p MIMAT0019977 Homo sapiens miR-4799-3p
acuggcaugcugcauuuauaua

SEQ ID NO: 1452 - RNA, 22 nt, Artificial sequence
  >hsa-miR-4799-5p MIMAT0019976 Homo sapiens miR-4799-5p
aucuaaaugcagcaugccaguc

SEQ ID NO: 1453 - RNA, 19 nt, Artificial sequence
  >hsa-miR-4800-3p MIMAT0019979 Homo sapiens miR-4800-3p
cauccguccgucuguccac

SEQ ID NO: 1454 - RNA, 21 nt, Artificial sequence
  >hsa-miR-4800-5p MIMAT0019978 Homo sapiens miR-4800-5p
aguggaccgaggaaggaagga

SEQ ID NO: 1455 - RNA, 22 nt, Artificial sequence
  >hsa-miR-4801 MIMAT0019980 Homo sapiens miR-4801
uacacaagaaaaccaaggcuca

SEQ ID NO: 1456 - RNA, 23 nt, Artificial sequence
  >hsa-miR-4802-3p MIMAT0019982 Homo sapiens miR-4802-3p
uacauggauggaaaccuucaagc

SEQ ID NO: 1457 - RNA, 22 nt, Artificial sequence
  >hsa-miR-4802-5p MIMAT0019981 Homo sapiens miR-4802-5p
uauggagguucuagaccauguu

SEQ ID NO: 1458 - RNA, 21 nt, Artificial sequence
  >hsa-miR-4803 MIMAT0019983 Homo sapiens miR-4803
uaacauaauaguguggauuga

SEQ ID NO: 1459 - RNA, 21 nt, Artificial sequence
  >hsa-miR-4804-3p MIMAT0019985 Homo sapiens miR-4804-3p
ugcuuaaccuugcccucgaaa

SEQ ID NO: 1460 - RNA, 21 nt, Artificial sequence
  >hsa-miR-4804-5p MIMAT0019984 Homo sapiens miR-4804-5p
uuggacgguaagguuaagcaa

SEQ ID NO: 1461 - RNA, 21 nt, Artificial sequence
  >hsa-miR-483-3p MIMAT0002173 Homo sapiens miR-483-3p
ucacuccucuccucccgucuu

SEQ ID NO: 1462 - RNA, 22 nt, Artificial sequence
  >hsa-miR-483-5p MIMAT0004761 Homo sapiens miR-483-5p
aagacgggaggaaagaagggag

SEQ ID NO: 1463 - RNA, 22 nt, Artificial sequence
  >hsa-miR-484 MIMAT0002174 Homo sapiens miR-484
ucaggcucaguccccucccgau

SEQ ID NO: 1464 - RNA, 22 nt, Artificial sequence
  >hsa-miR-485-3p MIMAT0002176 Homo sapiens miR-485-3p
gucauacacggcucuccucucu

SEQ ID NO: 1465 - RNA, 22 nt, Artificial sequence
  >hsa-miR-485-5p MIMAT0002175 Homo sapiens miR-485-5p
agaggcuggccgugaugaauuc

SEQ ID NO: 1466 - RNA, 21 nt, Artificial sequence
  >hsa-miR-486-3p MIMAT0004762 Homo sapiens miR-486-3p
cggggcagcucaguacaggau

SEQ ID NO: 1467 - RNA, 22 nt, Artificial sequence
  >hsa-miR-486-5p MIMAT0002177 Homo sapiens miR-486-5p
uccuguacugagcugccccgag

SEQ ID NO: 1468 - RNA, 22 nt, Artificial sequence
  >hsa-miR-487a-3p MIMAT0002178 Homo sapiens miR-487a-3p
aaucauacagggacauccaguu

SEQ ID NO: 1469 - RNA, 22 nt, Artificial sequence
  >hsa-miR-487a-5p MIMAT0026559 Homo sapiens miR-487a-5p
gugguuaucccugcuguguucg

SEQ ID NO: 1470 - RNA, 22 nt, Artificial sequence
  >hsa-miR-487b-3p MIMAT0003180 Homo sapiens miR-487b-3p
aaucguacagggucauccacuu

SEQ ID NO: 1471 - RNA, 22 nt, Artificial sequence
  >hsa-miR-487b-5p MIMAT0026614 Homo sapiens miR-487b-5p
gugguuaucccuguccuguucg

SEQ ID NO: 1472 - RNA, 21 nt, Artificial sequence
  >hsa-miR-488-3p MIMAT0004763 Homo sapiens miR-488-3p
uugaaaggcuauuucuugguc

SEQ ID NO: 1473 - RNA, 21 nt, Artificial sequence
  >hsa-miR-488-5p MIMAT0002804 Homo sapiens miR-488-5p
cccagauaauggcacucucaa

SEQ ID NO: 1474 - RNA, 22 nt, Artificial sequence
  >hsa-miR-489-3p MIMAT0002805 Homo sapiens miR-489-3p
gugacaucacauauacggcagc

SEQ ID NO: 1475 - RNA, 22 nt, Artificial sequence
  >hsa-miR-489-5p MIMAT0026605 Homo sapiens miR-489-5p
ggucguaugugugacgccauuu

SEQ ID NO: 1476 - RNA, 22 nt, Artificial sequence
  >hsa-miR-490-3p MIMAT0002806 Homo sapiens miR-490-3p
caaccuggaggacuccaugcug

SEQ ID NO: 1477 - RNA, 20 nt, Artificial sequence
  >hsa-miR-490-5p MIMAT0004764 Homo sapiens miR-490-5p
ccauggaucuccaggugggu

SEQ ID NO: 1478 - RNA, 22 nt, Artificial sequence
  >hsa-miR-491-3p MIMAT0004765 Homo sapiens miR-491-3p
cuuaugcaagauucccuucuac

SEQ ID NO: 1479 - RNA, 22 nt, Artificial sequence
  >hsa-miR-491-5p MIMAT0002807 Homo sapiens miR-491-5p
aguggggaacccuuccaugagg

SEQ ID NO: 1480 - RNA, 23 nt, Artificial sequence
  >hsa-miR-492 MIMAT0002812 Homo sapiens miR-492
aggaccugcgggacaagauucuu

SEQ ID NO: 1481 - RNA, 22 nt, Artificial sequence
  >hsa-miR-493-3p MIMAT0003161 Homo sapiens miR-493-3p
ugaaggucuacugugugccagg

SEQ ID NO: 1482 - RNA, 22 nt, Artificial sequence
  >hsa-miR-493-5p MIMAT0002813 Homo sapiens miR-493-5p
uuguacaugguaggcuuucauu

SEQ ID NO: 1483 - RNA, 22 nt, Artificial sequence
  >hsa-miR-494-3p MIMAT0002816 Homo sapiens miR-494-3p
ugaaacauacacgggaaaccuc

SEQ ID NO: 1484 - RNA, 23 nt, Artificial sequence
  >hsa-miR-494-5p MIMAT0026607 Homo sapiens miR-494-5p
agguuguccguguugucuucucu

SEQ ID NO: 1485 - RNA, 22 nt, Artificial sequence
  >hsa-miR-495-3p MIMAT0002817 Homo sapiens miR-495-3p
aaacaaacauggugcacuucuu

SEQ ID NO: 1486 - RNA, 22 nt, Artificial sequence
  >hsa-miR-495-5p MIMAT0022924 Homo sapiens miR-495-5p
gaaguugcccauguuauuuucg

SEQ ID NO: 1487 - RNA, 22 nt, Artificial sequence
  >hsa-miR-496 MIMAT0002818 Homo sapiens miR-496
ugaguauuacauggccaaucuc

SEQ ID NO: 1488 - RNA, 22 nt, Artificial sequence
  >hsa-miR-497-3p MIMAT0004768 Homo sapiens miR-497-3p
caaaccacacugugguguuaga

SEQ ID NO: 1489 - RNA, 21 nt, Artificial sequence
  >hsa-miR-497-5p MIMAT0002820 Homo sapiens miR-497-5p
cagcagcacacugugguuugu

SEQ ID NO: 1490 - RNA, 23 nt, Artificial sequence
  >hsa-miR-498 MIMAT0002824 Homo sapiens miR-498
uuucaagccagggggcguuuuuc

SEQ ID NO: 1491 - RNA, 20 nt, Artificial sequence
  >hsa-miR-4999-3p MIMAT0021018 Homo sapiens miR-4999-3p
ucacuaccugacaauacagu

SEQ ID NO: 1492 - RNA, 21 nt, Artificial sequence
  >hsa-miR-4999-5p MIMAT0021017 Homo sapiens miR-4999-5p
ugcuguauugucagguaguga

SEQ ID NO: 1493 - RNA, 22 nt, Artificial sequence
  >hsa-miR-499a-3p MIMAT0004772 Homo sapiens miR-499a-3p
aacaucacagcaagucugugcu

SEQ ID NO: 1494 - RNA, 21 nt, Artificial sequence
  >hsa-miR-499a-5p MIMAT0002870 Homo sapiens miR-499a-5p
uuaagacuugcagugauguuu

SEQ ID NO: 1495 - RNA, 22 nt, Artificial sequence
  >hsa-miR-499b-3p MIMAT0019898 Homo sapiens miR-499b-3p
aacaucacugcaagucuuaaca

SEQ ID NO: 1496 - RNA, 21 nt, Artificial sequence
  >hsa-miR-499b-5p MIMAT0019897 Homo sapiens miR-499b-5p
acagacuugcugugauguuca

SEQ ID NO: 1497 - RNA, 22 nt, Artificial sequence
  >hsa-miR-5000-3p MIMAT0021020 Homo sapiens miR-5000-3p
ucaggacacuucugaacuugga

SEQ ID NO: 1498 - RNA, 22 nt, Artificial sequence
  >hsa-miR-5000-5p MIMAT0021019 Homo sapiens miR-5000-5p
caguucagaaguguuccugagu

SEQ ID NO: 1499 - RNA, 22 nt, Artificial sequence
  >hsa-miR-5001-3p MIMAT0021022 Homo sapiens miR-5001-3p
uucugccucuguccagguccuu

SEQ ID NO: 1500 - RNA, 24 nt, Artificial sequence
  >hsa-miR-5001-5p MIMAT0021021 Homo sapiens miR-5001-5p
agggcuggacucagcggcggagcu

SEQ ID NO: 1501 - RNA, 21 nt, Artificial sequence
  >hsa-miR-5002-3p MIMAT0021024 Homo sapiens miR-5002-3p
ugacugccucacugaccacuu

SEQ ID NO: 1502 - RNA, 24 nt, Artificial sequence
  >hsa-miR-5002-5p MIMAT0021023 Homo sapiens miR-5002-5p
aauuugguuucugaggcacuuagu

SEQ ID NO: 1503 - RNA, 21 nt, Artificial sequence
  >hsa-miR-5003-3p MIMAT0021026 Homo sapiens miR-5003-3p
uacuuuucuagguuguugggg

SEQ ID NO: 1504 - RNA, 23 nt, Artificial sequence
  >hsa-miR-5003-5p MIMAT0021025 Homo sapiens miR-5003-5p
ucacaacaaccuugcaggguaga

SEQ ID NO: 1505 - RNA, 22 nt, Artificial sequence
  >hsa-miR-5004-3p MIMAT0021028 Homo sapiens miR-5004-3p
cuuggauuuuccugggccucag

SEQ ID NO: 1506 - RNA, 22 nt, Artificial sequence
  >hsa-miR-5004-5p MIMAT0021027 Homo sapiens miR-5004-5p
ugaggacagggcaaauucacga

SEQ ID NO: 1507 - RNA, 21 nt, Artificial sequence
  >hsa-miR-5006-3p MIMAT0021034 Homo sapiens miR-5006-3p
uuucccuuuccauccuggcag

SEQ ID NO: 1508 - RNA, 21 nt, Artificial sequence
  >hsa-miR-5006-5p MIMAT0021033 Homo sapiens miR-5006-5p
uugccagggcaggagguggaa

SEQ ID NO: 1509 - RNA, 22 nt, Artificial sequence
  >hsa-miR-5007-3p MIMAT0021036 Homo sapiens miR-5007-3p
aucauaugaaccaaacucuaau

SEQ ID NO: 1510 - RNA, 22 nt, Artificial sequence
  >hsa-miR-5007-5p MIMAT0021035 Homo sapiens miR-5007-5p
uagagucuggcugauaugguuu

SEQ ID NO: 1511 - RNA, 21 nt, Artificial sequence
  >hsa-miR-5008-3p MIMAT0021040 Homo sapiens miR-5008-3p
ccugugcucccagggccucgc

SEQ ID NO: 1512 - RNA, 22 nt, Artificial sequence
  >hsa-miR-5008-5p MIMAT0021039 Homo sapiens miR-5008-5p
ugaggcccuuggggcacagugg

SEQ ID NO: 1513 - RNA, 22 nt, Artificial sequence
  >hsa-miR-5009-3p MIMAT0021042 Homo sapiens miR-5009-3p
uccuaaaucugaaaguccaaaa

SEQ ID NO: 1514 - RNA, 24 nt, Artificial sequence
  >hsa-miR-5009-5p MIMAT0021041 Homo sapiens miR-5009-5p
uuggacuuuuucagauuuggggau

SEQ ID NO: 1515 - RNA, 22 nt, Artificial sequence
  >hsa-miR-500a-3p MIMAT0002871 Homo sapiens miR-500a-3p
augcaccugggcaaggauucug

SEQ ID NO: 1516 - RNA, 23 nt, Artificial sequence
  >hsa-miR-500a-5p MIMAT0004773 Homo sapiens miR-500a-5p
uaauccuugcuaccugggugaga

SEQ ID NO: 1517 - RNA, 20 nt, Artificial sequence
  >hsa-miR-500b-3p MIMAT0027032 Homo sapiens miR-500b-3p
gcacccaggcaaggauucug

SEQ ID NO: 1518 - RNA, 18 nt, Artificial sequence
  >hsa-miR-500b-5p MIMAT0016925 Homo sapiens miR-500b-5p
aauccuugcuaccugggu

SEQ ID NO: 1519 - RNA, 22 nt, Artificial sequence
  >hsa-miR-501-3p MIMAT0004774 Homo sapiens miR-501-3p
aaugcacccgggcaaggauucu

SEQ ID NO: 1520 - RNA, 22 nt, Artificial sequence
  >hsa-miR-501-5p MIMAT0002872 Homo sapiens miR-501-5p
aauccuuugucccugggugaga

SEQ ID NO: 1521 - RNA, 22 nt, Artificial sequence
  >hsa-miR-5010-3p MIMAT0021044 Homo sapiens miR-5010-3p
uuuugugucucccauuccccag

SEQ ID NO: 1522 - RNA, 22 nt, Artificial sequence
  >hsa-miR-5010-5p MIMAT0021043 Homo sapiens miR-5010-5p
agggggauggcagagcaaaauu

SEQ ID NO: 1523 - RNA, 22 nt, Artificial sequence
  >hsa-miR-5011-3p MIMAT0021046 Homo sapiens miR-5011-3p
gugcauggcuguauauauaaca

SEQ ID NO: 1524 - RNA, 21 nt, Artificial sequence
  >hsa-miR-5011-5p MIMAT0021045 Homo sapiens miR-5011-5p
uauauauacagccaugcacuc

SEQ ID NO: 1525 - RNA, 22 nt, Artificial sequence
  >hsa-miR-502-3p MIMAT0004775 Homo sapiens miR-502-3p
aaugcaccugggcaaggauuca

SEQ ID NO: 1526 - RNA, 21 nt, Artificial sequence
  >hsa-miR-502-5p MIMAT0002873 Homo sapiens miR-502-5p
auccuugcuaucugggugcua

SEQ ID NO: 1527 - RNA, 23 nt, Artificial sequence
  >hsa-miR-503-3p MIMAT0022925 Homo sapiens miR-503-3p
gggguauuguuuccgcugccagg

SEQ ID NO: 1528 - RNA, 23 nt, Artificial sequence
  >hsa-miR-503-5p MIMAT0002874 Homo sapiens miR-503-5p
uagcagcgggaacaguucugcag

SEQ ID NO: 1529 - RNA, 21 nt, Artificial sequence
  >hsa-miR-504-3p MIMAT0026612 Homo sapiens miR-504-3p
gggagugcagggcaggguuuc

SEQ ID NO: 1530 - RNA, 22 nt, Artificial sequence
  >hsa-miR-504-5p MIMAT0002875 Homo sapiens miR-504-5p
agacccuggucugcacucuauc

SEQ ID NO: 1531 - RNA, 21 nt, Artificial sequence
  >hsa-miR-5047 MIMAT0020541 Homo sapiens miR-5047
uugcagcugcgguuguaaggu

SEQ ID NO: 1532 - RNA, 22 nt, Artificial sequence
  >hsa-miR-505-3p MIMAT0002876 Homo sapiens miR-505-3p
cgucaacacuugcugguuuccu

SEQ ID NO: 1533 - RNA, 22 nt, Artificial sequence
  >hsa-miR-505-5p MIMAT0004776 Homo sapiens miR-505-5p
gggagccaggaaguauugaugu

SEQ ID NO: 1534 - RNA, 21 nt, Artificial sequence
  >hsa-miR-506-3p MIMAT0002878 Homo sapiens miR-506-3p
uaaggcacccuucugaguaga

SEQ ID NO: 1535 - RNA, 22 nt, Artificial sequence
  >hsa-miR-506-5p MIMAT0022701 Homo sapiens miR-506-5p
uauucaggaagguguuacuuaa

SEQ ID NO: 1536 - RNA, 21 nt, Artificial sequence
  >hsa-miR-507 MIMAT0002879 Homo sapiens miR-507
uuuugcaccuuuuggagugaa

SEQ ID NO: 1537 - RNA, 23 nt, Artificial sequence
  >hsa-miR-508-3p MIMAT0002880 Homo sapiens miR-508-3p
ugauuguagccuuuuggaguaga

SEQ ID NO: 1538 - RNA, 23 nt, Artificial sequence
  >hsa-miR-508-5p MIMAT0004778 Homo sapiens miR-508-5p
uacuccagagggcgucacucaug

SEQ ID NO: 1539 - RNA, 23 nt, Artificial sequence
  >hsa-miR-5087 MIMAT0021079 Homo sapiens miR-5087
ggguuuguagcuuugcuggcaug

SEQ ID NO: 1540 - RNA, 21 nt, Artificial sequence
  >hsa-miR-5088-3p MIMAT0027041 Homo sapiens miR-5088-3p
ucccuucuuccugggcccuca

SEQ ID NO: 1541 - RNA, 24 nt, Artificial sequence
  >hsa-miR-5088-5p MIMAT0021080 Homo sapiens miR-5088-5p
cagggcucagggauuggauggagg

SEQ ID NO: 1542 - RNA, 23 nt, Artificial sequence
  >hsa-miR-5089-3p MIMAT0022984 Homo sapiens miR-5089-3p
augcuacucggaaaucccacuga

SEQ ID NO: 1543 - RNA, 21 nt, Artificial sequence
  >hsa-miR-5089-5p MIMAT0021081 Homo sapiens miR-5089-5p
gugggauuucugaguagcauc

SEQ ID NO: 1544 - RNA, 22 nt, Artificial sequence
  >hsa-miR-509-3-5p MIMAT0004975 Homo sapiens miR-509-3-5p
uacugcagacguggcaaucaug

SEQ ID NO: 1545 - RNA, 22 nt, Artificial sequence
  >hsa-miR-509-3p MIMAT0002881 Homo sapiens miR-509-3p
ugauugguacgucuguggguag

SEQ ID NO: 1546 - RNA, 21 nt, Artificial sequence
  >hsa-miR-509-5p MIMAT0004779 Homo sapiens miR-509-5p
uacugcagacaguggcaauca

SEQ ID NO: 1547 - RNA, 23 nt, Artificial sequence
  >hsa-miR-5090 MIMAT0021082 Homo sapiens miR-5090
ccggggcagauugguguagggug

SEQ ID NO: 1548 - RNA, 23 nt, Artificial sequence
  >hsa-miR-5091 MIMAT0021083 Homo sapiens miR-5091
acggagacgacaagacugugcug

SEQ ID NO: 1549 - RNA, 22 nt, Artificial sequence
  >hsa-miR-5092 MIMAT0021084 Homo sapiens miR-5092
aauccacgcugagcuuggcauc

SEQ ID NO: 1550 - RNA, 23 nt, Artificial sequence
  >hsa-miR-5093 MIMAT0021085 Homo sapiens miR-5093
aggaaaugaggcuggcuaggagc

SEQ ID NO: 1551 - RNA, 22 nt, Artificial sequence
  >hsa-miR-5094 MIMAT0021086 Homo sapiens miR-5094
aaucagugaaugccuugaaccu

SEQ ID NO: 1552 - RNA, 21 nt, Artificial sequence
  >hsa-miR-5095 MIMAT0020600 Homo sapiens miR-5095
uuacaggcgugaaccaccgcg

SEQ ID NO: 1553 - RNA, 21 nt, Artificial sequence
  >hsa-miR-5096 MIMAT0020603 Homo sapiens miR-5096
guuucaccauguuggucaggc

SEQ ID NO: 1554 - RNA, 21 nt, Artificial sequence
  >hsa-miR-510-3p MIMAT0026613 Homo sapiens miR-510-3p
auugaaaccucuaagagugga

SEQ ID NO: 1555 - RNA, 22 nt, Artificial sequence
  >hsa-miR-510-5p MIMAT0002882 Homo sapiens miR-510-5p
uacucaggagaguggcaaucac

SEQ ID NO: 1556 - RNA, 22 nt, Artificial sequence
  >hsa-miR-5100 MIMAT0022259 Homo sapiens miR-5100
uucagaucccagcggugccucu

SEQ ID NO: 1557 - RNA, 20 nt, Artificial sequence
  >hsa-miR-511-3p MIMAT0026606 Homo sapiens miR-511-3p
aauguguagcaaaagacaga

SEQ ID NO: 1558 - RNA, 21 nt, Artificial sequence
  >hsa-miR-511-5p MIMAT0002808 Homo sapiens miR-511-5p
gugucuuuugcucugcaguca

SEQ ID NO: 1559 - RNA, 22 nt, Artificial sequence
  >hsa-miR-512-3p MIMAT0002823 Homo sapiens miR-512-3p
aagugcugucauagcugagguc

SEQ ID NO: 1560 - RNA, 23 nt, Artificial sequence
  >hsa-miR-512-5p MIMAT0002822 Homo sapiens miR-512-5p
cacucagccuugagggcacuuuc

SEQ ID NO: 1561 - RNA, 23 nt, Artificial sequence
  >hsa-miR-513a-3p MIMAT0004777 Homo sapiens miR-513a-3p
uaaauuucaccuuucugagaagg

SEQ ID NO: 1562 - RNA, 18 nt, Artificial sequence
  >hsa-miR-513a-5p MIMAT0002877 Homo sapiens miR-513a-5p
uucacagggaggugucau

SEQ ID NO: 1563 - RNA, 22 nt, Artificial sequence
  >hsa-miR-513b-3p MIMAT0026749 Homo sapiens miR-513b-3p
aaaugucaccuuuuugagagga

SEQ ID NO: 1564 - RNA, 22 nt, Artificial sequence
  >hsa-miR-513b-5p MIMAT0005788 Homo sapiens miR-513b-5p
uucacaaggaggugucauuuau

SEQ ID NO: 1565 - RNA, 23 nt, Artificial sequence
  >hsa-miR-513c-3p MIMAT0022728 Homo sapiens miR-513c-3p
uaaauuucaccuuucugagaaga

SEQ ID NO: 1566 - RNA, 22 nt, Artificial sequence
  >hsa-miR-513c-5p MIMAT0005789 Homo sapiens miR-513c-5p
uucucaaggaggugucguuuau

SEQ ID NO: 1567 - RNA, 21 nt, Artificial sequence
  >hsa-miR-514a-3p MIMAT0002883 Homo sapiens miR-514a-3p
auugacacuucugugaguaga

SEQ ID NO: 1568 - RNA, 23 nt, Artificial sequence
  >hsa-miR-514a-5p MIMAT0022702 Homo sapiens miR-514a-5p
uacucuggagagugacaaucaug

SEQ ID NO: 1569 - RNA, 21 nt, Artificial sequence
  >hsa-miR-514b-3p MIMAT0015088 Homo sapiens miR-514b-3p
auugacaccucugugagugga

SEQ ID NO: 1570 - RNA, 22 nt, Artificial sequence
  >hsa-miR-514b-5p MIMAT0015087 Homo sapiens miR-514b-5p
uucucaagagggaggcaaucau

SEQ ID NO: 1571 - RNA, 22 nt, Artificial sequence
  >hsa-miR-515-3p MIMAT0002827 Homo sapiens miR-515-3p
gagugccuucuuuuggagcguu

SEQ ID NO: 1572 - RNA, 24 nt, Artificial sequence
  >hsa-miR-515-5p MIMAT0002826 Homo sapiens miR-515-5p
uucuccaaaagaaagcacuuucug

SEQ ID NO: 1573 - RNA, 18 nt, Artificial sequence
  >hsa-miR-516a-3p MIMAT0006778 Homo sapiens miR-516a-3p
ugcuuccuuucagagggu

SEQ ID NO: 1574 - RNA, 23 nt, Artificial sequence
  >hsa-miR-516a-5p MIMAT0004770 Homo sapiens miR-516a-5p
uucucgaggaaagaagcacuuuc

SEQ ID NO: 1575 - RNA, 18 nt, Artificial sequence
  >hsa-miR-516b-3p MIMAT0002860 Homo sapiens miR-516b-3p
ugcuuccuuucagagggu

SEQ ID NO: 1576 - RNA, 22 nt, Artificial sequence
  >hsa-miR-516b-5p MIMAT0002859 Homo sapiens miR-516b-5p
aucuggagguaagaagcacuuu

SEQ ID NO: 1577 - RNA, 22 nt, Artificial sequence
  >hsa-miR-517-5p MIMAT0002851 Homo sapiens miR-517-5p
ccucuagauggaagcacugucu

SEQ ID NO: 1578 - RNA, 22 nt, Artificial sequence
  >hsa-miR-517a-3p MIMAT0002852 Homo sapiens miR-517a-3p
aucgugcaucccuuuagagugu

SEQ ID NO: 1579 - RNA, 22 nt, Artificial sequence
  >hsa-miR-517b-3p MIMAT0002857 Homo sapiens miR-517b-3p
aucgugcaucccuuuagagugu

SEQ ID NO: 1580 - RNA, 22 nt, Artificial sequence
  >hsa-miR-517c-3p MIMAT0002866 Homo sapiens miR-517c-3p
aucgugcauccuuuuagagugu

SEQ ID NO: 1581 - RNA, 21 nt, Artificial sequence
  >hsa-miR-5186 MIMAT0021116 Homo sapiens miR-5186
agagauugguagaaaucaggu

SEQ ID NO: 1582 - RNA, 21 nt, Artificial sequence
  >hsa-miR-5187-3p MIMAT0021118 Homo sapiens miR-5187-3p
acugaauccucuuuuccucag

SEQ ID NO: 1583 - RNA, 22 nt, Artificial sequence
  >hsa-miR-5187-5p MIMAT0021117 Homo sapiens miR-5187-5p
ugggaugagggauugaagugga

SEQ ID NO: 1584 - RNA, 23 nt, Artificial sequence
  >hsa-miR-5188 MIMAT0021119 Homo sapiens miR-5188
aaucggacccauuuaaaccggag

SEQ ID NO: 1585 - RNA, 21 nt, Artificial sequence
  >hsa-miR-5189-3p MIMAT0027088 Homo sapiens miR-5189-3p
ugccaaccgucagagcccaga

SEQ ID NO: 1586 - RNA, 24 nt, Artificial sequence
  >hsa-miR-5189-5p MIMAT0021120 Homo sapiens miR-5189-5p
ucugggcacaggcggauggacagg

SEQ ID NO: 1587 - RNA, 22 nt, Artificial sequence
  >hsa-miR-518a-3p MIMAT0002863 Homo sapiens miR-518a-3p
gaaagcgcuucccuuugcugga

SEQ ID NO: 1588 - RNA, 20 nt, Artificial sequence
  >hsa-miR-518a-5p MIMAT0005457 Homo sapiens miR-518a-5p
cugcaaagggaagcccuuuc

SEQ ID NO: 1589 - RNA, 22 nt, Artificial sequence
  >hsa-miR-518b MIMAT0002844 Homo sapiens miR-518b
caaagcgcuccccuuuagaggu

SEQ ID NO: 1590 - RNA, 23 nt, Artificial sequence
  >hsa-miR-518c-3p MIMAT0002848 Homo sapiens miR-518c-3p
caaagcgcuucucuuuagagugu

SEQ ID NO: 1591 - RNA, 23 nt, Artificial sequence
  >hsa-miR-518c-5p MIMAT0002847 Homo sapiens miR-518c-5p
ucucuggagggaagcacuuucug

SEQ ID NO: 1592 - RNA, 21 nt, Artificial sequence
  >hsa-miR-518d-3p MIMAT0002864 Homo sapiens miR-518d-3p
caaagcgcuucccuuuggagc

SEQ ID NO: 1593 - RNA, 22 nt, Artificial sequence
  >hsa-miR-518d-5p MIMAT0005456 Homo sapiens miR-518d-5p
cucuagagggaagcacuuucug

SEQ ID NO: 1594 - RNA, 21 nt, Artificial sequence
  >hsa-miR-518e-3p MIMAT0002861 Homo sapiens miR-518e-3p
aaagcgcuucccuucagagug

SEQ ID NO: 1595 - RNA, 22 nt, Artificial sequence
  >hsa-miR-518e-5p MIMAT0005450 Homo sapiens miR-518e-5p
cucuagagggaagcgcuuucug

SEQ ID NO: 1596 - RNA, 21 nt, Artificial sequence
  >hsa-miR-518f-3p MIMAT0002842 Homo sapiens miR-518f-3p
gaaagcgcuucucuuuagagg

SEQ ID NO: 1597 - RNA, 22 nt, Artificial sequence
  >hsa-miR-518f-5p MIMAT0002841 Homo sapiens miR-518f-5p
cucuagagggaagcacuuucuc

SEQ ID NO: 1598 - RNA, 21 nt, Artificial sequence
  >hsa-miR-5190 MIMAT0021121 Homo sapiens miR-5190
ccagugacugagcuggagcca

SEQ ID NO: 1599 - RNA, 22 nt, Artificial sequence
  >hsa-miR-5191 MIMAT0021122 Homo sapiens miR-5191
aggauaggaagaaugaagugcu

SEQ ID NO: 1600 - RNA, 22 nt, Artificial sequence
  >hsa-miR-5192 MIMAT0021123 Homo sapiens miR-5192
aggagaguggauuccagguggu

SEQ ID NO: 1601 - RNA, 22 nt, Artificial sequence
  >hsa-miR-5193 MIMAT0021124 Homo sapiens miR-5193
uccuccucuaccucaucccagu

SEQ ID NO: 1602 - RNA, 22 nt, Artificial sequence
  >hsa-miR-5194 MIMAT0021125 Homo sapiens miR-5194
ugagggguuuggaaugggaugg

SEQ ID NO: 1603 - RNA, 21 nt, Artificial sequence
  >hsa-miR-5195-3p MIMAT0021127 Homo sapiens miR-5195-3p
auccaguucucugagggggcu

SEQ ID NO: 1604 - RNA, 22 nt, Artificial sequence
  >hsa-miR-5195-5p MIMAT0021126 Homo sapiens miR-5195-5p
aaccccuaaggcaacuggaugg

SEQ ID NO: 1605 - RNA, 21 nt, Artificial sequence
  >hsa-miR-5196-3p MIMAT0021129 Homo sapiens miR-5196-3p
ucauccucgucucccucccag

SEQ ID NO: 1606 - RNA, 22 nt, Artificial sequence
  >hsa-miR-5196-5p MIMAT0021128 Homo sapiens miR-5196-5p
agggaaggggacgaggguuggg

SEQ ID NO: 1607 - RNA, 23 nt, Artificial sequence
  >hsa-miR-5197-3p MIMAT0021131 Homo sapiens miR-5197-3p
aagaagagacugagucaucgaau

SEQ ID NO: 1608 - RNA, 23 nt, Artificial sequence
  >hsa-miR-5197-5p MIMAT0021130 Homo sapiens miR-5197-5p
caauggcacaaacucauucuuga

SEQ ID NO: 1609 - RNA, 22 nt, Artificial sequence
  >hsa-miR-519a-3p MIMAT0002869 Homo sapiens miR-519a-3p
aaagugcauccuuuuagagugu

SEQ ID NO: 1610 - RNA, 22 nt, Artificial sequence
  >hsa-miR-519a-5p MIMAT0005452 Homo sapiens miR-519a-5p
cucuagagggaagcgcuuucug

SEQ ID NO: 1611 - RNA, 22 nt, Artificial sequence
  >hsa-miR-519b-3p MIMAT0002837 Homo sapiens miR-519b-3p
aaagugcauccuuuuagagguu

SEQ ID NO: 1612 - RNA, 22 nt, Artificial sequence
  >hsa-miR-519b-5p MIMAT0005454 Homo sapiens miR-519b-5p
cucuagagggaagcgcuuucug

SEQ ID NO: 1613 - RNA, 22 nt, Artificial sequence
  >hsa-miR-519c-3p MIMAT0002832 Homo sapiens miR-519c-3p
aaagugcaucuuuuuagaggau

SEQ ID NO: 1614 - RNA, 22 nt, Artificial sequence
  >hsa-miR-519c-5p MIMAT0002831 Homo sapiens miR-519c-5p
cucuagagggaagcgcuuucug

SEQ ID NO: 1615 - RNA, 22 nt, Artificial sequence
  >hsa-miR-519d-3p MIMAT0002853 Homo sapiens miR-519d-3p
caaagugccucccuuuagagug

SEQ ID NO: 1616 - RNA, 25 nt, Artificial sequence
  >hsa-miR-519d-5p MIMAT0026610 Homo sapiens miR-519d-5p
ccuccaaagggaagcgcuuucuguu

SEQ ID NO: 1617 - RNA, 22 nt, Artificial sequence
  >hsa-miR-519e-3p MIMAT0002829 Homo sapiens miR-519e-3p
aagugccuccuuuuagaguguu

SEQ ID NO: 1618 - RNA, 22 nt, Artificial sequence
  >hsa-miR-519e-5p MIMAT0002828 Homo sapiens miR-519e-5p
uucuccaaaagggagcacuuuc

SEQ ID NO: 1619 - RNA, 22 nt, Artificial sequence
  >hsa-miR-520a-3p MIMAT0002834 Homo sapiens miR-520a-3p
aaagugcuucccuuuggacugu

SEQ ID NO: 1620 - RNA, 21 nt, Artificial sequence
  >hsa-miR-520a-5p MIMAT0002833 Homo sapiens miR-520a-5p
cuccagagggaaguacuuucu

SEQ ID NO: 1621 - RNA, 21 nt, Artificial sequence
  >hsa-miR-520b MIMAT0002843 Homo sapiens miR-520b
aaagugcuuccuuuuagaggg

SEQ ID NO: 1622 - RNA, 22 nt, Artificial sequence
  >hsa-miR-520c-3p MIMAT0002846 Homo sapiens miR-520c-3p
aaagugcuuccuuuuagagggu

SEQ ID NO: 1623 - RNA, 22 nt, Artificial sequence
  >hsa-miR-520c-5p MIMAT0005455 Homo sapiens miR-520c-5p
cucuagagggaagcacuuucug

SEQ ID NO: 1624 - RNA, 22 nt, Artificial sequence
  >hsa-miR-520d-3p MIMAT0002856 Homo sapiens miR-520d-3p
aaagugcuucucuuuggugggu

SEQ ID NO: 1625 - RNA, 20 nt, Artificial sequence
  >hsa-miR-520d-5p MIMAT0002855 Homo sapiens miR-520d-5p
cuacaaagggaagcccuuuc

SEQ ID NO: 1626 - RNA, 21 nt, Artificial sequence
  >hsa-miR-520e MIMAT0002825 Homo sapiens miR-520e
aaagugcuuccuuuuugaggg

SEQ ID NO: 1627 - RNA, 22 nt, Artificial sequence
  >hsa-miR-520f-3p MIMAT0002830 Homo sapiens miR-520f-3p
aagugcuuccuuuuagaggguu

SEQ ID NO: 1628 - RNA, 22 nt, Artificial sequence
  >hsa-miR-520f-5p MIMAT0026609 Homo sapiens miR-520f-5p
ccucuaaagggaagcgcuuucu

SEQ ID NO: 1629 - RNA, 24 nt, Artificial sequence
  >hsa-miR-520g-3p MIMAT0002858 Homo sapiens miR-520g-3p
acaaagugcuucccuuuagagugu

SEQ ID NO: 1630 - RNA, 23 nt, Artificial sequence
  >hsa-miR-520g-5p MIMAT0026611 Homo sapiens miR-520g-5p
ucuagaggaagcacuuucuguuu

SEQ ID NO: 1631 - RNA, 22 nt, Artificial sequence
  >hsa-miR-520h MIMAT0002867 Homo sapiens miR-520h
acaaagugcuucccuuuagagu

SEQ ID NO: 1632 - RNA, 22 nt, Artificial sequence
  >hsa-miR-521 MIMAT0002854 Homo sapiens miR-521
aacgcacuucccuuuagagugu

SEQ ID NO: 1633 - RNA, 22 nt, Artificial sequence
  >hsa-miR-522-3p MIMAT0002868 Homo sapiens miR-522-3p
aaaaugguucccuuuagagugu

SEQ ID NO: 1634 - RNA, 22 nt, Artificial sequence
  >hsa-miR-522-5p MIMAT0005451 Homo sapiens miR-522-5p
cucuagagggaagcgcuuucug

SEQ ID NO: 1635 - RNA, 23 nt, Artificial sequence
  >hsa-miR-523-3p MIMAT0002840 Homo sapiens miR-523-3p
gaacgcgcuucccuauagagggu

SEQ ID NO: 1636 - RNA, 22 nt, Artificial sequence
  >hsa-miR-523-5p MIMAT0005449 Homo sapiens miR-523-5p
cucuagagggaagcgcuuucug

SEQ ID NO: 1637 - RNA, 21 nt, Artificial sequence
  >hsa-miR-524-3p MIMAT0002850 Homo sapiens miR-524-3p
gaaggcgcuucccuuuggagu

SEQ ID NO: 1638 - RNA, 22 nt, Artificial sequence
  >hsa-miR-524-5p MIMAT0002849 Homo sapiens miR-524-5p
cuacaaagggaagcacuuucuc

SEQ ID NO: 1639 - RNA, 22 nt, Artificial sequence
  >hsa-miR-525-3p MIMAT0002839 Homo sapiens miR-525-3p
gaaggcgcuucccuuuagagcg

SEQ ID NO: 1640 - RNA, 21 nt, Artificial sequence
  >hsa-miR-525-5p MIMAT0002838 Homo sapiens miR-525-5p
cuccagagggaugcacuuucu

SEQ ID NO: 1641 - RNA, 22 nt, Artificial sequence
  >hsa-miR-526a MIMAT0002845 Homo sapiens miR-526a
cucuagagggaagcacuuucug

SEQ ID NO: 1642 - RNA, 22 nt, Artificial sequence
  >hsa-miR-526b-3p MIMAT0002836 Homo sapiens miR-526b-3p
gaaagugcuuccuuuuagaggc

SEQ ID NO: 1643 - RNA, 23 nt, Artificial sequence
  >hsa-miR-526b-5p MIMAT0002835 Homo sapiens miR-526b-5p
cucuugagggaagcacuuucugu

SEQ ID NO: 1644 - RNA, 20 nt, Artificial sequence
  >hsa-miR-527 MIMAT0002862 Homo sapiens miR-527
cugcaaagggaagcccuuuc

SEQ ID NO: 1645 - RNA, 22 nt, Artificial sequence
  >hsa-miR-532-3p MIMAT0004780 Homo sapiens miR-532-3p
ccucccacacccaaggcuugca

SEQ ID NO: 1646 - RNA, 22 nt, Artificial sequence
  >hsa-miR-532-5p MIMAT0002888 Homo sapiens miR-532-5p
caugccuugaguguaggaccgu

SEQ ID NO: 1647 - RNA, 22 nt, Artificial sequence
  >hsa-miR-539-3p MIMAT0022705 Homo sapiens miR-539-3p
aucauacaaggacaauuucuuu

SEQ ID NO: 1648 - RNA, 22 nt, Artificial sequence
  >hsa-miR-539-5p MIMAT0003163 Homo sapiens miR-539-5p
ggagaaauuauccuuggugugu

SEQ ID NO: 1649 - RNA, 22 nt, Artificial sequence
  >hsa-miR-541-3p MIMAT0004920 Homo sapiens miR-541-3p
uggugggcacagaaucuggacu

SEQ ID NO: 1650 - RNA, 25 nt, Artificial sequence
  >hsa-miR-541-5p MIMAT0004919 Homo sapiens miR-541-5p
aaaggauucugcugucggucccacu

SEQ ID NO: 1651 - RNA, 22 nt, Artificial sequence
  >hsa-miR-542-3p MIMAT0003389 Homo sapiens miR-542-3p
ugugacagauugauaacugaaa

SEQ ID NO: 1652 - RNA, 23 nt, Artificial sequence
  >hsa-miR-542-5p MIMAT0003340 Homo sapiens miR-542-5p
ucggggaucaucaugucacgaga

SEQ ID NO: 1653 - RNA, 22 nt, Artificial sequence
  >hsa-miR-543 MIMAT0004954 Homo sapiens miR-543
aaacauucgcggugcacuucuu

SEQ ID NO: 1654 - RNA, 22 nt, Artificial sequence
  >hsa-miR-544a MIMAT0003164 Homo sapiens miR-544a
auucugcauuuuuagcaaguuc

SEQ ID NO: 1655 - RNA, 22 nt, Artificial sequence
  >hsa-miR-544b MIMAT0015004 Homo sapiens miR-544b
accugagguugugcauuucuaa

SEQ ID NO: 1656 - RNA, 22 nt, Artificial sequence
  >hsa-miR-545-3p MIMAT0003165 Homo sapiens miR-545-3p
ucagcaaacauuuauugugugc

SEQ ID NO: 1657 - RNA, 22 nt, Artificial sequence
  >hsa-miR-545-5p MIMAT0004785 Homo sapiens miR-545-5p
ucaguaaauguuuauuagauga

SEQ ID NO: 1658 - RNA, 22 nt, Artificial sequence
  >hsa-miR-548a-3p MIMAT0003251 Homo sapiens miR-548a-3p
caaaacuggcaauuacuuuugc

SEQ ID NO: 1659 - RNA, 22 nt, Artificial sequence
  >hsa-miR-548a-5p MIMAT0004803 Homo sapiens miR-548a-5p
aaaaguaauugcgaguuuuacc

SEQ ID NO: 1660 - RNA, 25 nt, Artificial sequence
  >hsa-miR-548aa MIMAT0018447 Homo sapiens miR-548aa
aaaaaccacaauuacuuuugcacca

SEQ ID NO: 1661 - RNA, 22 nt, Artificial sequence
  >hsa-miR-548ab MIMAT0018928 Homo sapiens miR-548ab
aaaaguaauuguggauuuugcu

SEQ ID NO: 1662 - RNA, 22 nt, Artificial sequence
  >hsa-miR-548ac MIMAT0018938 Homo sapiens miR-548ac
caaaaaccggcaauuacuuuug

SEQ ID NO: 1663 - RNA, 22 nt, Artificial sequence
  >hsa-miR-548ad-3p MIMAT0018946 Homo sapiens miR-548ad-3p
gaaaacgacaaugacuuuugca

SEQ ID NO: 1664 - RNA, 20 nt, Artificial sequence
  >hsa-miR-548ad-5p MIMAT0032114 Homo sapiens miR-548ad-5p
aaaaguaauugugguuuuug

SEQ ID NO: 1665 - RNA, 21 nt, Artificial sequence
  >hsa-miR-548ae-3p MIMAT0018954 Homo sapiens miR-548ae-3p
caaaaacugcaauuacuuuca

SEQ ID NO: 1666 - RNA, 20 nt, Artificial sequence
  >hsa-miR-548ae-5p MIMAT0032115 Homo sapiens miR-548ae-5p
aaaaguaauugugguuuuug

SEQ ID NO: 1667 - RNA, 21 nt, Artificial sequence
  >hsa-miR-548ag MIMAT0018969 Homo sapiens miR-548ag
aaagguaauugugguuucugc

SEQ ID NO: 1668 - RNA, 22 nt, Artificial sequence
  >hsa-miR-548ah-3p MIMAT0020957 Homo sapiens miR-548ah-3p
caaaaacugcaguuacuuuugc

SEQ ID NO: 1669 - RNA, 20 nt, Artificial sequence
  >hsa-miR-548ah-5p MIMAT0018972 Homo sapiens miR-548ah-5p
aaaagugauugcaguguuug

SEQ ID NO: 1670 - RNA, 22 nt, Artificial sequence
  >hsa-miR-548ai MIMAT0018989 Homo sapiens miR-548ai
aaagguaauugcaguuuuuccc

SEQ ID NO: 1671 - RNA, 21 nt, Artificial sequence
  >hsa-miR-548aj-3p MIMAT0018990 Homo sapiens miR-548aj-3p
uaaaaacugcaauuacuuuua

SEQ ID NO: 1672 - RNA, 23 nt, Artificial sequence
  >hsa-miR-548aj-5p MIMAT0022739 Homo sapiens miR-548aj-5p
ugcaaaaguaauugcaguuuuug

SEQ ID NO: 1673 - RNA, 21 nt, Artificial sequence
  >hsa-miR-548ak MIMAT0019013 Homo sapiens miR-548ak
aaaaguaacugcgguuuuuga

SEQ ID NO: 1674 - RNA, 22 nt, Artificial sequence
  >hsa-miR-548al MIMAT0019024 Homo sapiens miR-548al
aacggcaaugacuuuuguacca

SEQ ID NO: 1675 - RNA, 22 nt, Artificial sequence
  >hsa-miR-548am-3p MIMAT0019076 Homo sapiens miR-548am-3p
caaaaacugcaguuacuuuugu

SEQ ID NO: 1676 - RNA, 22 nt, Artificial sequence
  >hsa-miR-548am-5p MIMAT0022740 Homo sapiens miR-548am-5p
aaaaguaauugcgguuuuugcc

SEQ ID NO: 1677 - RNA, 20 nt, Artificial sequence
  >hsa-miR-548an MIMAT0019079 Homo sapiens miR-548an
aaaaggcauugugguuuuug

SEQ ID NO: 1678 - RNA, 22 nt, Artificial sequence
  >hsa-miR-548ao-3p MIMAT0021030 Homo sapiens miR-548ao-3p
aaagaccgugacuacuuuugca

SEQ ID NO: 1679 - RNA, 22 nt, Artificial sequence
  >hsa-miR-548ao-5p MIMAT0021029 Homo sapiens miR-548ao-5p
agaaguaacuacgguuuuugca

SEQ ID NO: 1680 - RNA, 19 nt, Artificial sequence
  >hsa-miR-548ap-3p MIMAT0021038 Homo sapiens miR-548ap-3p
aaaaaccacaauuacuuuu

SEQ ID NO: 1681 - RNA, 19 nt, Artificial sequence
  >hsa-miR-548ap-5p MIMAT0021037 Homo sapiens miR-548ap-5p
aaaaguaauugcggucuuu

SEQ ID NO: 1682 - RNA, 22 nt, Artificial sequence
  >hsa-miR-548aq-3p MIMAT0022264 Homo sapiens miR-548aq-3p
caaaaacugcaauuacuuuugc

SEQ ID NO: 1683 - RNA, 22 nt, Artificial sequence
  >hsa-miR-548aq-5p MIMAT0022263 Homo sapiens miR-548aq-5p
gaaaguaauugcuguuuuugcc

SEQ ID NO: 1684 - RNA, 21 nt, Artificial sequence
  >hsa-miR-548ar-3p MIMAT0022266 Homo sapiens miR-548ar-3p
uaaaacugcaguuauuuuugc

SEQ ID NO: 1685 - RNA, 21 nt, Artificial sequence
  >hsa-miR-548ar-5p MIMAT0022265 Homo sapiens miR-548ar-5p
aaaaguaauugcaguuuuugc

SEQ ID NO: 1686 - RNA, 22 nt, Artificial sequence
  >hsa-miR-548as-3p MIMAT0022268 Homo sapiens miR-548as-3p
uaaaacccacaauuauguuugu

SEQ ID NO: 1687 - RNA, 22 nt, Artificial sequence
  >hsa-miR-548as-5p MIMAT0022267 Homo sapiens miR-548as-5p
aaaaguaauugcggguuuugcc

SEQ ID NO: 1688 - RNA, 21 nt, Artificial sequence
  >hsa-miR-548at-3p MIMAT0022278 Homo sapiens miR-548at-3p
caaaaccgcaguaacuuuugu

SEQ ID NO: 1689 - RNA, 22 nt, Artificial sequence
  >hsa-miR-548at-5p MIMAT0022277 Homo sapiens miR-548at-5p
aaaaguuauugcgguuuuggcu

SEQ ID NO: 1690 - RNA, 21 nt, Artificial sequence
  >hsa-miR-548au-3p MIMAT0022292 Homo sapiens miR-548au-3p
uggcaguuacuuuugcaccag

SEQ ID NO: 1691 - RNA, 21 nt, Artificial sequence
  >hsa-miR-548au-5p MIMAT0022291 Homo sapiens miR-548au-5p
aaaaguaauugcgguuuuugc

SEQ ID NO: 1692 - RNA, 20 nt, Artificial sequence
  >hsa-miR-548av-3p MIMAT0022304 Homo sapiens miR-548av-3p
aaaacugcaguuacuuuugc

SEQ ID NO: 1693 - RNA, 18 nt, Artificial sequence
  >hsa-miR-548av-5p MIMAT0022303 Homo sapiens miR-548av-5p
aaaaguacuugcggauuu

SEQ ID NO: 1694 - RNA, 20 nt, Artificial sequence
  >hsa-miR-548aw MIMAT0022471 Homo sapiens miR-548aw
gugcaaaagucaucacgguu

SEQ ID NO: 1695 - RNA, 22 nt, Artificial sequence
  >hsa-miR-548ax MIMAT0022474 Homo sapiens miR-548ax
agaaguaauugcgguuuugcca

SEQ ID NO: 1696 - RNA, 22 nt, Artificial sequence
  >hsa-miR-548ay-3p MIMAT0025453 Homo sapiens miR-548ay-3p
caaaaccgcgauuacucuugca

SEQ ID NO: 1697 - RNA, 21 nt, Artificial sequence
  >hsa-miR-548ay-5p MIMAT0025452 Homo sapiens miR-548ay-5p
aaaaguaauugugguuuuugc

SEQ ID NO: 1698 - RNA, 21 nt, Artificial sequence
  >hsa-miR-548az-3p MIMAT0025457 Homo sapiens miR-548az-3p
aaaaacugcaaucacuuuugc

SEQ ID NO: 1699 - RNA, 22 nt, Artificial sequence
  >hsa-miR-548az-5p MIMAT0025456 Homo sapiens miR-548az-5p
caaaagugauugugguuuuugc

SEQ ID NO: 1700 - RNA, 22 nt, Artificial sequence
  >hsa-miR-548b-3p MIMAT0003254 Homo sapiens miR-548b-3p
caagaaccucaguugcuuuugu

SEQ ID NO: 1701 - RNA, 22 nt, Artificial sequence
  >hsa-miR-548b-5p MIMAT0004798 Homo sapiens miR-548b-5p
aaaaguaauugugguuuuggcc

SEQ ID NO: 1702 - RNA, 22 nt, Artificial sequence
  >hsa-miR-548ba MIMAT0031175 Homo sapiens miR-548ba
aaagguaacugugauuuuugcu

SEQ ID NO: 1703 - RNA, 22 nt, Artificial sequence
  >hsa-miR-548bb-3p MIMAT0035704 Homo sapiens miR-548bb-3p
caaaaaccauaguuacuuuugc

SEQ ID NO: 1704 - RNA, 22 nt, Artificial sequence
  >hsa-miR-548bb-5p MIMAT0035703 Homo sapiens miR-548bb-5p
aaaaguaacuaugguuuuugcc

SEQ ID NO: 1705 - RNA, 22 nt, Artificial sequence
  >hsa-miR-548c-3p MIMAT0003285 Homo sapiens miR-548c-3p
caaaaaucucaauuacuuuugc

SEQ ID NO: 1706 - RNA, 22 nt, Artificial sequence
  >hsa-miR-548c-5p MIMAT0004806 Homo sapiens miR-548c-5p
aaaaguaauugcgguuuuugcc

SEQ ID NO: 1707 - RNA, 22 nt, Artificial sequence
  >hsa-miR-548d-3p MIMAT0003323 Homo sapiens miR-548d-3p
caaaaaccacaguuucuuuugc

SEQ ID NO: 1708 - RNA, 22 nt, Artificial sequence
  >hsa-miR-548d-5p MIMAT0004812 Homo sapiens miR-548d-5p
aaaaguaauugugguuuuugcc

SEQ ID NO: 1709 - RNA, 22 nt, Artificial sequence
  >hsa-miR-548e-3p MIMAT0005874 Homo sapiens miR-548e-3p
aaaaacugagacuacuuuugca

SEQ ID NO: 1710 - RNA, 22 nt, Artificial sequence
  >hsa-miR-548e-5p MIMAT0026736 Homo sapiens miR-548e-5p
caaaagcaaucgcgguuuuugc

SEQ ID NO: 1711 - RNA, 19 nt, Artificial sequence
  >hsa-miR-548f-3p MIMAT0005895 Homo sapiens miR-548f-3p
aaaaacuguaauuacuuuu

SEQ ID NO: 1712 - RNA, 22 nt, Artificial sequence
  >hsa-miR-548f-5p MIMAT0026739 Homo sapiens miR-548f-5p
ugcaaaaguaaucacaguuuuu

SEQ ID NO: 1713 - RNA, 22 nt, Artificial sequence
  >hsa-miR-548g-3p MIMAT0005912 Homo sapiens miR-548g-3p
aaaacuguaauuacuuuuguac

SEQ ID NO: 1714 - RNA, 23 nt, Artificial sequence
  >hsa-miR-548g-5p MIMAT0022722 Homo sapiens miR-548g-5p
ugcaaaaguaauugcaguuuuug

SEQ ID NO: 1715 - RNA, 23 nt, Artificial sequence
  >hsa-miR-548h-3p MIMAT0022723 Homo sapiens miR-548h-3p
caaaaaccgcaauuacuuuugca

SEQ ID NO: 1716 - RNA, 22 nt, Artificial sequence
  >hsa-miR-548h-5p MIMAT0005928 Homo sapiens miR-548h-5p
aaaaguaaucgcgguuuuuguc

SEQ ID NO: 1717 - RNA, 22 nt, Artificial sequence
  >hsa-miR-548i MIMAT0005935 Homo sapiens miR-548i
aaaaguaauugcggauuuugcc

SEQ ID NO: 1718 - RNA, 21 nt, Artificial sequence
  >hsa-miR-548j-3p MIMAT0026737 Homo sapiens miR-548j-3p
caaaaacugcauuacuuuugc

SEQ ID NO: 1719 - RNA, 22 nt, Artificial sequence
  >hsa-miR-548j-5p MIMAT0005875 Homo sapiens miR-548j-5p
aaaaguaauugcggucuuuggu

SEQ ID NO: 1720 - RNA, 22 nt, Artificial sequence
  >hsa-miR-548k MIMAT0005882 Homo sapiens miR-548k
aaaaguacuugcggauuuugcu

SEQ ID NO: 1721 - RNA, 22 nt, Artificial sequence
  >hsa-miR-548l MIMAT0005889 Homo sapiens miR-548l
aaaaguauuugcggguuuuguc

SEQ ID NO: 1722 - RNA, 21 nt, Artificial sequence
  >hsa-miR-548m MIMAT0005917 Homo sapiens miR-548m
caaagguauuugugguuuuug

SEQ ID NO: 1723 - RNA, 22 nt, Artificial sequence
  >hsa-miR-548n MIMAT0005916 Homo sapiens miR-548n
caaaaguaauuguggauuuugu

SEQ ID NO: 1724 - RNA, 22 nt, Artificial sequence
  >hsa-miR-548o-3p MIMAT0005919 Homo sapiens miR-548o-3p
ccaaaacugcaguuacuuuugc

SEQ ID NO: 1725 - RNA, 22 nt, Artificial sequence
  >hsa-miR-548o-5p MIMAT0022738 Homo sapiens miR-548o-5p
aaaaguaauugcgguuuuugcc

SEQ ID NO: 1726 - RNA, 22 nt, Artificial sequence
  >hsa-miR-548p MIMAT0005934 Homo sapiens miR-548p
uagcaaaaacugcaguuacuuu

SEQ ID NO: 1727 - RNA, 22 nt, Artificial sequence
  >hsa-miR-548q MIMAT0011163 Homo sapiens miR-548q
gcuggugcaaaaguaauggcgg

SEQ ID NO: 1728 - RNA, 23 nt, Artificial sequence
  >hsa-miR-548s MIMAT0014987 Homo sapiens miR-548s
auggccaaaacugcaguuauuuu

SEQ ID NO: 1729 - RNA, 25 nt, Artificial sequence
  >hsa-miR-548t-3p MIMAT0022730 Homo sapiens miR-548t-3p
aaaaaccacaauuacuuuugcacca

SEQ ID NO: 1730 - RNA, 21 nt, Artificial sequence
  >hsa-miR-548t-5p MIMAT0015009 Homo sapiens miR-548t-5p
caaaagugaucgugguuuuug

SEQ ID NO: 1731 - RNA, 23 nt, Artificial sequence
  >hsa-miR-548u MIMAT0015013 Homo sapiens miR-548u
caaagacugcaauuacuuuugcg

SEQ ID NO: 1732 - RNA, 22 nt, Artificial sequence
  >hsa-miR-548v MIMAT0015020 Homo sapiens miR-548v
agcuacaguuacuuuugcacca

SEQ ID NO: 1733 - RNA, 23 nt, Artificial sequence
  >hsa-miR-548w MIMAT0015060 Homo sapiens miR-548w
aaaaguaacugcgguuuuugccu

SEQ ID NO: 1734 - RNA, 20 nt, Artificial sequence
  >hsa-miR-548x-3p MIMAT0015081 Homo sapiens miR-548x-3p
uaaaaacugcaauuacuuuc

SEQ ID NO: 1735 - RNA, 23 nt, Artificial sequence
  >hsa-miR-548x-5p MIMAT0022733 Homo sapiens miR-548x-5p
ugcaaaaguaauugcaguuuuug

SEQ ID NO: 1736 - RNA, 22 nt, Artificial sequence
  >hsa-miR-548y MIMAT0018354 Homo sapiens miR-548y
aaaaguaaucacuguuuuugcc

SEQ ID NO: 1737 - RNA, 23 nt, Artificial sequence
  >hsa-miR-548z MIMAT0018446 Homo sapiens miR-548z
caaaaaccgcaauuacuuuugca

SEQ ID NO: 1738 - RNA, 21 nt, Artificial sequence
  >hsa-miR-549a MIMAT0003333 Homo sapiens miR-549a
ugacaacuauggaugagcucu

SEQ ID NO: 1739 - RNA, 20 nt, Artificial sequence
  >hsa-miR-550a-3-5p MIMAT0020925 Homo sapiens miR-550a-3-5p
agugccugagggaguaagag

SEQ ID NO: 1740 - RNA, 22 nt, Artificial sequence
  >hsa-miR-550a-3p MIMAT0003257 Homo sapiens miR-550a-3p
ugucuuacucccucaggcacau

SEQ ID NO: 1741 - RNA, 23 nt, Artificial sequence
  >hsa-miR-550a-5p MIMAT0004800 Homo sapiens miR-550a-5p
agugccugagggaguaagagccc

SEQ ID NO: 1742 - RNA, 22 nt, Artificial sequence
  >hsa-miR-550b-2-5p MIMAT0022737 Homo sapiens miR-550b-2-5p
augugccugagggaguaagaca

SEQ ID NO: 1743 - RNA, 20 nt, Artificial sequence
  >hsa-miR-550b-3p MIMAT0018445 Homo sapiens miR-550b-3p
ucuuacucccucaggcacug

SEQ ID NO: 1744 - RNA, 21 nt, Artificial sequence
  >hsa-miR-551a MIMAT0003214 Homo sapiens miR-551a
gcgacccacucuugguuucca

SEQ ID NO: 1745 - RNA, 21 nt, Artificial sequence
  >hsa-miR-551b-3p MIMAT0003233 Homo sapiens miR-551b-3p
gcgacccauacuugguuucag

SEQ ID NO: 1746 - RNA, 22 nt, Artificial sequence
  >hsa-miR-551b-5p MIMAT0004794 Homo sapiens miR-551b-5p
gaaaucaagcgugggugagacc

SEQ ID NO: 1747 - RNA, 21 nt, Artificial sequence
  >hsa-miR-552-3p MIMAT0003215 Homo sapiens miR-552-3p
aacaggugacugguuagacaa

SEQ ID NO: 1748 - RNA, 21 nt, Artificial sequence
  >hsa-miR-552-5p MIMAT0026615 Homo sapiens miR-552-5p
guuuaaccuuuugccuguugg

SEQ ID NO: 1749 - RNA, 21 nt, Artificial sequence
  >hsa-miR-553 MIMAT0003216 Homo sapiens miR-553
aaaacggugagauuuuguuuu

SEQ ID NO: 1750 - RNA, 21 nt, Artificial sequence
  >hsa-miR-554 MIMAT0003217 Homo sapiens miR-554
gcuaguccugacucagccagu

SEQ ID NO: 1751 - RNA, 21 nt, Artificial sequence
  >hsa-miR-555 MIMAT0003219 Homo sapiens miR-555
aggguaagcugaaccucugau

SEQ ID NO: 1752 - RNA, 22 nt, Artificial sequence
  >hsa-miR-556-3p MIMAT0004793 Homo sapiens miR-556-3p
auauuaccauuagcucaucuuu

SEQ ID NO: 1753 - RNA, 22 nt, Artificial sequence
  >hsa-miR-556-5p MIMAT0003220 Homo sapiens miR-556-5p
gaugagcucauuguaauaugag

SEQ ID NO: 1754 - RNA, 23 nt, Artificial sequence
  >hsa-miR-557 MIMAT0003221 Homo sapiens miR-557
guuugcacgggugggccuugucu

SEQ ID NO: 1755 - RNA, 19 nt, Artificial sequence
  >hsa-miR-5571-3p MIMAT0022258 Homo sapiens miR-5571-3p
guccuaggaggcuccucug

SEQ ID NO: 1756 - RNA, 21 nt, Artificial sequence
  >hsa-miR-5571-5p MIMAT0022257 Homo sapiens miR-5571-5p
caauucucaaaggagccuccc

SEQ ID NO: 1757 - RNA, 21 nt, Artificial sequence
  >hsa-miR-5572 MIMAT0022260 Homo sapiens miR-5572
guuggggugcaggggucugcu

SEQ ID NO: 1758 - RNA, 22 nt, Artificial sequence
  >hsa-miR-5579-3p MIMAT0022270 Homo sapiens miR-5579-3p
uuagcuuaaggaguaccagauc

SEQ ID NO: 1759 - RNA, 21 nt, Artificial sequence
  >hsa-miR-5579-5p MIMAT0022269 Homo sapiens miR-5579-5p
uaugguacuccuuaagcuaac

SEQ ID NO: 1760 - RNA, 19 nt, Artificial sequence
  >hsa-miR-558 MIMAT0003222 Homo sapiens miR-558
ugagcugcuguaccaaaau

SEQ ID NO: 1761 - RNA, 22 nt, Artificial sequence
  >hsa-miR-5580-3p MIMAT0022274 Homo sapiens miR-5580-3p
cacauaugaagugagccagcac

SEQ ID NO: 1762 - RNA, 22 nt, Artificial sequence
  >hsa-miR-5580-5p MIMAT0022273 Homo sapiens miR-5580-5p
ugcuggcucauuucauaugugu

SEQ ID NO: 1763 - RNA, 22 nt, Artificial sequence
  >hsa-miR-5581-3p MIMAT0022276 Homo sapiens miR-5581-3p
uuccaugccuccuagaaguucc

SEQ ID NO: 1764 - RNA, 22 nt, Artificial sequence
  >hsa-miR-5581-5p MIMAT0022275 Homo sapiens miR-5581-5p
agccuuccaggagaaauggaga

SEQ ID NO: 1765 - RNA, 22 nt, Artificial sequence
  >hsa-miR-5582-3p MIMAT0022280 Homo sapiens miR-5582-3p
uaaaacuuuaagugugccuagg

SEQ ID NO: 1766 - RNA, 22 nt, Artificial sequence
  >hsa-miR-5582-5p MIMAT0022279 Homo sapiens miR-5582-5p
uaggcacacuuaaaguuauagc

SEQ ID NO: 1767 - RNA, 22 nt, Artificial sequence
  >hsa-miR-5583-3p MIMAT0022282 Homo sapiens miR-5583-3p
gaauauggguauauuaguuugg

SEQ ID NO: 1768 - RNA, 22 nt, Artificial sequence
  >hsa-miR-5583-5p MIMAT0022281 Homo sapiens miR-5583-5p
aaacuaauauacccauauucug

SEQ ID NO: 1769 - RNA, 22 nt, Artificial sequence
  >hsa-miR-5584-3p MIMAT0022284 Homo sapiens miR-5584-3p
uaguucuucccuuugcccaauu

SEQ ID NO: 1770 - RNA, 22 nt, Artificial sequence
  >hsa-miR-5584-5p MIMAT0022283 Homo sapiens miR-5584-5p
cagggaaaugggaagaacuaga

SEQ ID NO: 1771 - RNA, 22 nt, Artificial sequence
  >hsa-miR-5585-3p MIMAT0022286 Homo sapiens miR-5585-3p
cugaauagcugggacuacaggu

SEQ ID NO: 1772 - RNA, 22 nt, Artificial sequence
  >hsa-miR-5585-5p MIMAT0022285 Homo sapiens miR-5585-5p
ugaaguaccagcuacucgagag

SEQ ID NO: 1773 - RNA, 22 nt, Artificial sequence
  >hsa-miR-5586-3p MIMAT0022288 Homo sapiens miR-5586-3p
cagagugacaagcugguuaaag

SEQ ID NO: 1774 - RNA, 22 nt, Artificial sequence
  >hsa-miR-5586-5p MIMAT0022287 Homo sapiens miR-5586-5p
uauccagcuuguuacuauaugc

SEQ ID NO: 1775 - RNA, 21 nt, Artificial sequence
  >hsa-miR-5587-3p MIMAT0022290 Homo sapiens miR-5587-3p
gccccgggcagugugaucauc

SEQ ID NO: 1776 - RNA, 18 nt, Artificial sequence
  >hsa-miR-5587-5p MIMAT0022289 Homo sapiens miR-5587-5p
auggucaccuccgggacu

SEQ ID NO: 1777 - RNA, 19 nt, Artificial sequence
  >hsa-miR-5588-3p MIMAT0022296 Homo sapiens miR-5588-3p
aagucccacuaaugccagc

SEQ ID NO: 1778 - RNA, 21 nt, Artificial sequence
  >hsa-miR-5588-5p MIMAT0022295 Homo sapiens miR-5588-5p
acuggcauuagugggacuuuu

SEQ ID NO: 1779 - RNA, 23 nt, Artificial sequence
  >hsa-miR-5589-3p MIMAT0022298 Homo sapiens miR-5589-3p
ugcacauggcaaccuagcuccca

SEQ ID NO: 1780 - RNA, 21 nt, Artificial sequence
  >hsa-miR-5589-5p MIMAT0022297 Homo sapiens miR-5589-5p
ggcugggugcucuugugcagu

SEQ ID NO: 1781 - RNA, 21 nt, Artificial sequence
  >hsa-miR-559 MIMAT0003223 Homo sapiens miR-559
uaaaguaaauaugcaccaaaa

SEQ ID NO: 1782 - RNA, 21 nt, Artificial sequence
  >hsa-miR-5590-3p MIMAT0022300 Homo sapiens miR-5590-3p
aauaaaguucauguauggcaa

SEQ ID NO: 1783 - RNA, 21 nt, Artificial sequence
  >hsa-miR-5590-5p MIMAT0022299 Homo sapiens miR-5590-5p
uugccauacauagacuuuauu

SEQ ID NO: 1784 - RNA, 21 nt, Artificial sequence
  >hsa-miR-5591-3p MIMAT0022302 Homo sapiens miR-5591-3p
auacccauagcuuagcuccca

SEQ ID NO: 1785 - RNA, 21 nt, Artificial sequence
  >hsa-miR-5591-5p MIMAT0022301 Homo sapiens miR-5591-5p
ugggagcuaagcuauggguau

SEQ ID NO: 1786 - RNA, 22 nt, Artificial sequence
  >hsa-miR-561-3p MIMAT0003225 Homo sapiens miR-561-3p
caaaguuuaagauccuugaagu

SEQ ID NO: 1787 - RNA, 22 nt, Artificial sequence
  >hsa-miR-561-5p MIMAT0022706 Homo sapiens miR-561-5p
aucaaggaucuuaaacuuugcc

SEQ ID NO: 1788 - RNA, 20 nt, Artificial sequence
  >hsa-miR-562 MIMAT0003226 Homo sapiens miR-562
aaaguagcuguaccauuugc

SEQ ID NO: 1789 - RNA, 19 nt, Artificial sequence
  >hsa-miR-563 MIMAT0003227 Homo sapiens miR-563
agguugacauacguuuccc

SEQ ID NO: 1790 - RNA, 19 nt, Artificial sequence
  >hsa-miR-564 MIMAT0003228 Homo sapiens miR-564
aggcacggugucagcaggc

SEQ ID NO: 1791 - RNA, 19 nt, Artificial sequence
  >hsa-miR-566 MIMAT0003230 Homo sapiens miR-566
gggcgccugugaucccaac

SEQ ID NO: 1792 - RNA, 23 nt, Artificial sequence
  >hsa-miR-567 MIMAT0003231 Homo sapiens miR-567
aguauguucuuccaggacagaac

SEQ ID NO: 1793 - RNA, 20 nt, Artificial sequence
  >hsa-miR-568 MIMAT0003232 Homo sapiens miR-568
auguauaaauguauacacac

SEQ ID NO: 1794 - RNA, 22 nt, Artificial sequence
  >hsa-miR-5680 MIMAT0022468 Homo sapiens miR-5680
gagaaaugcuggacuaaucugc

SEQ ID NO: 1795 - RNA, 22 nt, Artificial sequence
  >hsa-miR-5681a MIMAT0022469 Homo sapiens miR-5681a
agaaaggguggcaauaccucuu

SEQ ID NO: 1796 - RNA, 22 nt, Artificial sequence
  >hsa-miR-5681b MIMAT0022480 Homo sapiens miR-5681b
agguauugccacccuuucuagu

SEQ ID NO: 1797 - RNA, 22 nt, Artificial sequence
  >hsa-miR-5682 MIMAT0022470 Homo sapiens miR-5682
guagcaccuugcaggauaaggu

SEQ ID NO: 1798 - RNA, 24 nt, Artificial sequence
  >hsa-miR-5683 MIMAT0022472 Homo sapiens miR-5683
uacagaugcagauucucugacuuc

SEQ ID NO: 1799 - RNA, 20 nt, Artificial sequence
  >hsa-miR-5684 MIMAT0022473 Homo sapiens miR-5684
aacucuagccugagcaacag

SEQ ID NO: 1800 - RNA, 22 nt, Artificial sequence
  >hsa-miR-5685 MIMAT0022475 Homo sapiens miR-5685
acagcccagcaguuaucacggg

SEQ ID NO: 1801 - RNA, 22 nt, Artificial sequence
  >hsa-miR-5687 MIMAT0022478 Homo sapiens miR-5687
uuagaacguuuuagggucaaau

SEQ ID NO: 1802 - RNA, 22 nt, Artificial sequence
  >hsa-miR-5688 MIMAT0022479 Homo sapiens miR-5688
uaacaaacaccuguaaaacagc

SEQ ID NO: 1803 - RNA, 22 nt, Artificial sequence
  >hsa-miR-5689 MIMAT0022481 Homo sapiens miR-5689
agcauacaccuguaguccuaga

SEQ ID NO: 1804 - RNA, 21 nt, Artificial sequence
  >hsa-miR-569 MIMAT0003234 Homo sapiens miR-569
aguuaaugaauccuggaaagu

SEQ ID NO: 1805 - RNA, 21 nt, Artificial sequence
  >hsa-miR-5690 MIMAT0022482 Homo sapiens miR-5690
ucagcuacuaccucuauuagg

SEQ ID NO: 1806 - RNA, 22 nt, Artificial sequence
  >hsa-miR-5691 MIMAT0022483 Homo sapiens miR-5691
uugcucugagcuccgagaaagc

SEQ ID NO: 1807 - RNA, 22 nt, Artificial sequence
  >hsa-miR-5692a MIMAT0022484 Homo sapiens miR-5692a
caaauaauaccacagugggugu

SEQ ID NO: 1808 - RNA, 20 nt, Artificial sequence
  >hsa-miR-5692b MIMAT0022497 Homo sapiens miR-5692b
aauaauaucacaguaggugu

SEQ ID NO: 1809 - RNA, 22 nt, Artificial sequence
  >hsa-miR-5692c MIMAT0022476 Homo sapiens miR-5692c
aauaauaucacaguagguguac

SEQ ID NO: 1810 - RNA, 22 nt, Artificial sequence
  >hsa-miR-5693 MIMAT0022486 Homo sapiens miR-5693
gcaguggcucugaaaugaacuc

SEQ ID NO: 1811 - RNA, 21 nt, Artificial sequence
  >hsa-miR-5694 MIMAT0022487 Homo sapiens miR-5694
cagaucaugggacugucucag

SEQ ID NO: 1812 - RNA, 22 nt, Artificial sequence
  >hsa-miR-5695 MIMAT0022488 Homo sapiens miR-5695
acuccaagaagaaucuagacag

SEQ ID NO: 1813 - RNA, 22 nt, Artificial sequence
  >hsa-miR-5696 MIMAT0022489 Homo sapiens miR-5696
cucauuuaaguagucugaugcc

SEQ ID NO: 1814 - RNA, 22 nt, Artificial sequence
  >hsa-miR-5697 MIMAT0022490 Homo sapiens miR-5697
ucaaguaguuucaugauaaagg

SEQ ID NO: 1815 - RNA, 22 nt, Artificial sequence
  >hsa-miR-5698 MIMAT0022491 Homo sapiens miR-5698
ugggggagugcagugauugugg

SEQ ID NO: 1816 - RNA, 22 nt, Artificial sequence
  >hsa-miR-5699-3p MIMAT0022492 Homo sapiens miR-5699-3p
uccugucuuuccuuguuggagc

SEQ ID NO: 1817 - RNA, 22 nt, Artificial sequence
  >hsa-miR-5699-5p MIMAT0027103 Homo sapiens miR-5699-5p
ugccccaacaaggaaggacaag

SEQ ID NO: 1818 - RNA, 22 nt, Artificial sequence
  >hsa-miR-570-3p MIMAT0003235 Homo sapiens miR-570-3p
cgaaaacagcaauuaccuuugc

SEQ ID NO: 1819 - RNA, 22 nt, Artificial sequence
  >hsa-miR-570-5p MIMAT0022707 Homo sapiens miR-570-5p
aaagguaauugcaguuuuuccc

SEQ ID NO: 1820 - RNA, 22 nt, Artificial sequence
  >hsa-miR-5700 MIMAT0022493 Homo sapiens miR-5700
uaaugcauuaaauuauugaagg

SEQ ID NO: 1821 - RNA, 19 nt, Artificial sequence
  >hsa-miR-5701 MIMAT0022494 Homo sapiens miR-5701
uuauugucacguucugauu

SEQ ID NO: 1822 - RNA, 22 nt, Artificial sequence
  >hsa-miR-5702 MIMAT0022495 Homo sapiens miR-5702
ugagucagcaacauaucccaug

SEQ ID NO: 1823 - RNA, 18 nt, Artificial sequence
  >hsa-miR-5703 MIMAT0022496 Homo sapiens miR-5703
aggagaagucgggaaggu

SEQ ID NO: 1824 - RNA, 22 nt, Artificial sequence
  >hsa-miR-5704 MIMAT0022498 Homo sapiens miR-5704
uuaggccaucaucccauuaugc

SEQ ID NO: 1825 - RNA, 23 nt, Artificial sequence
  >hsa-miR-5705 MIMAT0022499 Homo sapiens miR-5705
uguuucggggcucauggccugug

SEQ ID NO: 1826 - RNA, 22 nt, Artificial sequence
  >hsa-miR-5706 MIMAT0022500 Homo sapiens miR-5706
uucuggauaacaugcugaagcu

SEQ ID NO: 1827 - RNA, 22 nt, Artificial sequence
  >hsa-miR-5707 MIMAT0022501 Homo sapiens miR-5707
acguuugaaugcuguacaaggc

SEQ ID NO: 1828 - RNA, 20 nt, Artificial sequence
  >hsa-miR-5708 MIMAT0022502 Homo sapiens miR-5708
augagcgacugugccugacc

SEQ ID NO: 1829 - RNA, 21 nt, Artificial sequence
  >hsa-miR-571 MIMAT0003236 Homo sapiens miR-571
ugaguuggccaucugagugag

SEQ ID NO: 1830 - RNA, 20 nt, Artificial sequence
  >hsa-miR-572 MIMAT0003237 Homo sapiens miR-572
guccgcucggcgguggccca

SEQ ID NO: 1831 - RNA, 24 nt, Artificial sequence
  >hsa-miR-573 MIMAT0003238 Homo sapiens miR-573
cugaagugauguguaacugaucag

SEQ ID NO: 1832 - RNA, 20 nt, Artificial sequence
  >hsa-miR-5739 MIMAT0023116 Homo sapiens miR-5739
gcggagagagaauggggagc

SEQ ID NO: 1833 - RNA, 22 nt, Artificial sequence
  >hsa-miR-574-3p MIMAT0003239 Homo sapiens miR-574-3p
cacgcucaugcacacacccaca

SEQ ID NO: 1834 - RNA, 23 nt, Artificial sequence
  >hsa-miR-574-5p MIMAT0004795 Homo sapiens miR-574-5p
ugagugugugugugugagugugu

SEQ ID NO: 1835 - RNA, 19 nt, Artificial sequence
  >hsa-miR-575 MIMAT0003240 Homo sapiens miR-575
gagccaguuggacaggagc

SEQ ID NO: 1836 - RNA, 22 nt, Artificial sequence
  >hsa-miR-576-3p MIMAT0004796 Homo sapiens miR-576-3p
aagauguggaaaaauuggaauc

SEQ ID NO: 1837 - RNA, 22 nt, Artificial sequence
  >hsa-miR-576-5p MIMAT0003241 Homo sapiens miR-576-5p
auucuaauuucuccacgucuuu

SEQ ID NO: 1838 - RNA, 21 nt, Artificial sequence
  >hsa-miR-577 MIMAT0003242 Homo sapiens miR-577
uagauaaaauauugguaccug

SEQ ID NO: 1839 - RNA, 21 nt, Artificial sequence
  >hsa-miR-578 MIMAT0003243 Homo sapiens miR-578
cuucuugugcucuaggauugu

SEQ ID NO: 1840 - RNA, 20 nt, Artificial sequence
  >hsa-miR-5787 MIMAT0023252 Homo sapiens miR-5787
gggcuggggcgcggggaggu

SEQ ID NO: 1841 - RNA, 23 nt, Artificial sequence
  >hsa-miR-579-3p MIMAT0003244 Homo sapiens miR-579-3p
uucauuugguauaaaccgcgauu

SEQ ID NO: 1842 - RNA, 22 nt, Artificial sequence
  >hsa-miR-579-5p MIMAT0026616 Homo sapiens miR-579-5p
ucgcgguuugugccagaugacg

SEQ ID NO: 1843 - RNA, 22 nt, Artificial sequence
  >hsa-miR-580-3p MIMAT0003245 Homo sapiens miR-580-3p
uugagaaugaugaaucauuagg

SEQ ID NO: 1844 - RNA, 22 nt, Artificial sequence
  >hsa-miR-580-5p MIMAT0026617 Homo sapiens miR-580-5p
uaaugauucaucagacucagau

SEQ ID NO: 1845 - RNA, 21 nt, Artificial sequence
  >hsa-miR-581 MIMAT0003246 Homo sapiens miR-581
ucuuguguucucuagaucagu

SEQ ID NO: 1846 - RNA, 22 nt, Artificial sequence
  >hsa-miR-582-3p MIMAT0004797 Homo sapiens miR-582-3p
uaacugguugaacaacugaacc

SEQ ID NO: 1847 - RNA, 23 nt, Artificial sequence
  >hsa-miR-582-5p MIMAT0003247 Homo sapiens miR-582-5p
uuacaguuguucaaccaguuacu

SEQ ID NO: 1848 - RNA, 21 nt, Artificial sequence
  >hsa-miR-583 MIMAT0003248 Homo sapiens miR-583
caaagaggaaggucccauuac

SEQ ID NO: 1849 - RNA, 22 nt, Artificial sequence
  >hsa-miR-584-3p MIMAT0022708 Homo sapiens miR-584-3p
ucaguuccaggccaaccaggcu

SEQ ID NO: 1850 - RNA, 22 nt, Artificial sequence
  >hsa-miR-584-5p MIMAT0003249 Homo sapiens miR-584-5p
uuaugguuugccugggacugag

SEQ ID NO: 1851 - RNA, 19 nt, Artificial sequence
  >hsa-miR-585-3p MIMAT0003250 Homo sapiens miR-585-3p
ugggcguaucuguaugcua

SEQ ID NO: 1852 - RNA, 22 nt, Artificial sequence
  >hsa-miR-585-5p MIMAT0026618 Homo sapiens miR-585-5p
cuagcacacagauacgcccaga

SEQ ID NO: 1853 - RNA, 22 nt, Artificial sequence
  >hsa-miR-586 MIMAT0003252 Homo sapiens miR-586
uaugcauuguauuuuuaggucc

SEQ ID NO: 1854 - RNA, 21 nt, Artificial sequence
  >hsa-miR-587 MIMAT0003253 Homo sapiens miR-587
uuuccauaggugaugagucac

SEQ ID NO: 1855 - RNA, 21 nt, Artificial sequence
  >hsa-miR-588 MIMAT0003255 Homo sapiens miR-588
uuggccacaauggguuagaac

SEQ ID NO: 1856 - RNA, 24 nt, Artificial sequence
  >hsa-miR-589-3p MIMAT0003256 Homo sapiens miR-589-3p
ucagaacaaaugccgguucccaga

SEQ ID NO: 1857 - RNA, 22 nt, Artificial sequence
  >hsa-miR-589-5p MIMAT0004799 Homo sapiens miR-589-5p
ugagaaccacgucugcucugag

SEQ ID NO: 1858 - RNA, 21 nt, Artificial sequence
  >hsa-miR-590-3p MIMAT0004801 Homo sapiens miR-590-3p
uaauuuuauguauaagcuagu

SEQ ID NO: 1859 - RNA, 22 nt, Artificial sequence
  >hsa-miR-590-5p MIMAT0003258 Homo sapiens miR-590-5p
gagcuuauucauaaaagugcag

SEQ ID NO: 1860 - RNA, 20 nt, Artificial sequence
  >hsa-miR-591 MIMAT0003259 Homo sapiens miR-591
agaccauggguucucauugu

SEQ ID NO: 1861 - RNA, 22 nt, Artificial sequence
  >hsa-miR-592 MIMAT0003260 Homo sapiens miR-592
uugugucaauaugcgaugaugu

SEQ ID NO: 1862 - RNA, 19 nt, Artificial sequence
  >hsa-miR-593-3p MIMAT0004802 Homo sapiens miR-593-3p
ugucucugcugggguuucu

SEQ ID NO: 1863 - RNA, 25 nt, Artificial sequence
  >hsa-miR-593-5p MIMAT0003261 Homo sapiens miR-593-5p
aggcaccagccaggcauugcucagc

SEQ ID NO: 1864 - RNA, 21 nt, Artificial sequence
  >hsa-miR-595 MIMAT0003263 Homo sapiens miR-595
gaagugugccguggugugucu

SEQ ID NO: 1865 - RNA, 21 nt, Artificial sequence
  >hsa-miR-596 MIMAT0003264 Homo sapiens miR-596
aagccugcccggcuccucggg

SEQ ID NO: 1866 - RNA, 23 nt, Artificial sequence
  >hsa-miR-597-3p MIMAT0026619 Homo sapiens miR-597-3p
ugguucucuuguggcucaagcgu

SEQ ID NO: 1867 - RNA, 22 nt, Artificial sequence
  >hsa-miR-597-5p MIMAT0003265 Homo sapiens miR-597-5p
ugugucacucgaugaccacugu

SEQ ID NO: 1868 - RNA, 22 nt, Artificial sequence
  >hsa-miR-598-3p MIMAT0003266 Homo sapiens miR-598-3p
uacgucaucguugucaucguca

SEQ ID NO: 1869 - RNA, 23 nt, Artificial sequence
  >hsa-miR-598-5p MIMAT0026620 Homo sapiens miR-598-5p
gcggugaucccgauggugugagc

SEQ ID NO: 1870 - RNA, 20 nt, Artificial sequence
  >hsa-miR-599 MIMAT0003267 Homo sapiens miR-599
guugugucaguuuaucaaac

SEQ ID NO: 1871 - RNA, 23 nt, Artificial sequence
  >hsa-miR-600 MIMAT0003268 Homo sapiens miR-600
acuuacagacaagagccuugcuc

SEQ ID NO: 1872 - RNA, 22 nt, Artificial sequence
  >hsa-miR-601 MIMAT0003269 Homo sapiens miR-601
uggucuaggauuguuggaggag

SEQ ID NO: 1873 - RNA, 23 nt, Artificial sequence
  >hsa-miR-602 MIMAT0003270 Homo sapiens miR-602
gacacgggcgacagcugcggccc

SEQ ID NO: 1874 - RNA, 22 nt, Artificial sequence
  >hsa-miR-603 MIMAT0003271 Homo sapiens miR-603
cacacacugcaauuacuuuugc

SEQ ID NO: 1875 - RNA, 19 nt, Artificial sequence
  >hsa-miR-604 MIMAT0003272 Homo sapiens miR-604
aggcugcggaauucaggac

SEQ ID NO: 1876 - RNA, 22 nt, Artificial sequence
  >hsa-miR-605-3p MIMAT0026621 Homo sapiens miR-605-3p
agaaggcacuaugagauuuaga

SEQ ID NO: 1877 - RNA, 23 nt, Artificial sequence
  >hsa-miR-605-5p MIMAT0003273 Homo sapiens miR-605-5p
uaaaucccauggugccuucuccu

SEQ ID NO: 1878 - RNA, 21 nt, Artificial sequence
  >hsa-miR-606 MIMAT0003274 Homo sapiens miR-606
aaacuacugaaaaucaaagau

SEQ ID NO: 1879 - RNA, 21 nt, Artificial sequence
  >hsa-miR-6068 MIMAT0023693 Homo sapiens miR-6068
ccugcgagucuccggcggugg

SEQ ID NO: 1880 - RNA, 21 nt, Artificial sequence
  >hsa-miR-6069 MIMAT0023694 Homo sapiens miR-6069
gggcuagggccugcugccccc

SEQ ID NO: 1881 - RNA, 21 nt, Artificial sequence
  >hsa-miR-607 MIMAT0003275 Homo sapiens miR-607
guucaaauccagaucuauaac

SEQ ID NO: 1882 - RNA, 19 nt, Artificial sequence
  >hsa-miR-6070 MIMAT0023695 Homo sapiens miR-6070
ccgguuccagucccuggag

SEQ ID NO: 1883 - RNA, 19 nt, Artificial sequence
  >hsa-miR-6071 MIMAT0023696 Homo sapiens miR-6071
uucugcugccggccaaggc

SEQ ID NO: 1884 - RNA, 22 nt, Artificial sequence
  >hsa-miR-6072 MIMAT0023697 Homo sapiens miR-6072
uccucaucacacugcaccuuag

SEQ ID NO: 1885 - RNA, 20 nt, Artificial sequence
  >hsa-miR-6073 MIMAT0023698 Homo sapiens miR-6073
gguagugaguuaucagcuac

SEQ ID NO: 1886 - RNA, 20 nt, Artificial sequence
  >hsa-miR-6074 MIMAT0023699 Homo sapiens miR-6074
gauauucagaggcuaggugg

SEQ ID NO: 1887 - RNA, 21 nt, Artificial sequence
  >hsa-miR-6075 MIMAT0023700 Homo sapiens miR-6075
acggcccaggcggcauuggug

SEQ ID NO: 1888 - RNA, 21 nt, Artificial sequence
  >hsa-miR-6076 MIMAT0023701 Homo sapiens miR-6076
agcaugacagaggagaggugg

SEQ ID NO: 1889 - RNA, 21 nt, Artificial sequence
  >hsa-miR-6077 MIMAT0023702 Homo sapiens miR-6077
gggaagagcuguacggccuuc

SEQ ID NO: 1890 - RNA, 19 nt, Artificial sequence
  >hsa-miR-6078 MIMAT0023703 Homo sapiens miR-6078
ccgccugagcuagcugugg

SEQ ID NO: 1891 - RNA, 24 nt, Artificial sequence
  >hsa-miR-6079 MIMAT0023704 Homo sapiens miR-6079
uuggaagcuuggaccaacuagcug

SEQ ID NO: 1892 - RNA, 25 nt, Artificial sequence
  >hsa-miR-608 MIMAT0003276 Homo sapiens miR-608
aggggugguguugggacagcuccgu

SEQ ID NO: 1893 - RNA, 19 nt, Artificial sequence
  >hsa-miR-6080 MIMAT0023705 Homo sapiens miR-6080
ucuagugcgggcguucccg

SEQ ID NO: 1894 - RNA, 24 nt, Artificial sequence
  >hsa-miR-6081 MIMAT0023706 Homo sapiens miR-6081
aggagcagugccggccaaggcgcc

SEQ ID NO: 1895 - RNA, 19 nt, Artificial sequence
  >hsa-miR-6082 MIMAT0023707 Homo sapiens miR-6082
gaauacgucugguugaucc

SEQ ID NO: 1896 - RNA, 20 nt, Artificial sequence
  >hsa-miR-6083 MIMAT0023708 Homo sapiens miR-6083
cuuauaucagaggcuguggg

SEQ ID NO: 1897 - RNA, 20 nt, Artificial sequence
  >hsa-miR-6084 MIMAT0023709 Homo sapiens miR-6084
uuccgccagucgguggccgg

SEQ ID NO: 1898 - RNA, 19 nt, Artificial sequence
  >hsa-miR-6085 MIMAT0023710 Homo sapiens miR-6085
aaggggcugggggagcaca

SEQ ID NO: 1899 - RNA, 20 nt, Artificial sequence
  >hsa-miR-6086 MIMAT0023711 Homo sapiens miR-6086
ggagguugggaagggcagag

SEQ ID NO: 1900 - RNA, 18 nt, Artificial sequence
  >hsa-miR-6087 MIMAT0023712 Homo sapiens miR-6087
ugaggcgggggggcgagc

SEQ ID NO: 1901 - RNA, 20 nt, Artificial sequence
  >hsa-miR-6088 MIMAT0023713 Homo sapiens miR-6088
agagaugaagcgggggggcg

SEQ ID NO: 1902 - RNA, 24 nt, Artificial sequence
  >hsa-miR-6089 MIMAT0023714 Homo sapiens miR-6089
ggaggccgggguggggcggggcgg

SEQ ID NO: 1903 - RNA, 20 nt, Artificial sequence
  >hsa-miR-609 MIMAT0003277 Homo sapiens miR-609
aggguguuucucucaucucu

SEQ ID NO: 1904 - RNA, 19 nt, Artificial sequence
  >hsa-miR-6090 MIMAT0023715 Homo sapiens miR-6090
ggggagcgaggggcggggc

SEQ ID NO: 1905 - RNA, 21 nt, Artificial sequence
  >hsa-miR-610 MIMAT0003278 Homo sapiens miR-610
ugagcuaaaugugugcuggga

SEQ ID NO: 1906 - RNA, 23 nt, Artificial sequence
  >hsa-miR-611 MIMAT0003279 Homo sapiens miR-611
gcgaggaccccucggggucugac

SEQ ID NO: 1907 - RNA, 25 nt, Artificial sequence
  >hsa-miR-612 MIMAT0003280 Homo sapiens miR-612
gcugggcagggcuucugagcuccuu

SEQ ID NO: 1908 - RNA, 20 nt, Artificial sequence
  >hsa-miR-6124 MIMAT0024597 Homo sapiens miR-6124
gggaaaaggaagggggagga

SEQ ID NO: 1909 - RNA, 20 nt, Artificial sequence
  >hsa-miR-6125 MIMAT0024598 Homo sapiens miR-6125
gcggaaggcggagcggcgga

SEQ ID NO: 1910 - RNA, 18 nt, Artificial sequence
  >hsa-miR-6126 MIMAT0024599 Homo sapiens miR-6126
gugaaggcccggcggaga

SEQ ID NO: 1911 - RNA, 19 nt, Artificial sequence
  >hsa-miR-6127 MIMAT0024610 Homo sapiens miR-6127
ugagggagugggugggagg

SEQ ID NO: 1912 - RNA, 19 nt, Artificial sequence
  >hsa-miR-6128 MIMAT0024611 Homo sapiens miR-6128
acuggaauuggagucaaaa

SEQ ID NO: 1913 - RNA, 19 nt, Artificial sequence
  >hsa-miR-6129 MIMAT0024613 Homo sapiens miR-6129
ugagggaguuggguguaua

SEQ ID NO: 1914 - RNA, 20 nt, Artificial sequence
  >hsa-miR-613 MIMAT0003281 Homo sapiens miR-613
aggaauguuccuucuuugcc

SEQ ID NO: 1915 - RNA, 19 nt, Artificial sequence
  >hsa-miR-6130 MIMAT0024614 Homo sapiens miR-6130
ugagggaguggauuguaug

SEQ ID NO: 1916 - RNA, 19 nt, Artificial sequence
  >hsa-miR-6131 MIMAT0024615 Homo sapiens miR-6131
ggcuggucagaugggagug

SEQ ID NO: 1917 - RNA, 19 nt, Artificial sequence
  >hsa-miR-6132 MIMAT0024616 Homo sapiens miR-6132
agcagggcuggggauugca

SEQ ID NO: 1918 - RNA, 19 nt, Artificial sequence
  >hsa-miR-6133 MIMAT0024617 Homo sapiens miR-6133
ugagggaggagguugggua

SEQ ID NO: 1919 - RNA, 19 nt, Artificial sequence
  >hsa-miR-6134 MIMAT0024618 Homo sapiens miR-6134
ugaggugguaggauguaga

SEQ ID NO: 1920 - RNA, 23 nt, Artificial sequence
  >hsa-miR-614 MIMAT0003282 Homo sapiens miR-614
gaacgccuguucuugccaggugg

SEQ ID NO: 1921 - RNA, 22 nt, Artificial sequence
  >hsa-miR-615-3p MIMAT0003283 Homo sapiens miR-615-3p
uccgagccugggucucccucuu

SEQ ID NO: 1922 - RNA, 22 nt, Artificial sequence
  >hsa-miR-615-5p MIMAT0004804 Homo sapiens miR-615-5p
ggggguccccggugcucggauc

SEQ ID NO: 1923 - RNA, 22 nt, Artificial sequence
  >hsa-miR-616-3p MIMAT0004805 Homo sapiens miR-616-3p
agucauuggaggguuugagcag

SEQ ID NO: 1924 - RNA, 22 nt, Artificial sequence
  >hsa-miR-616-5p MIMAT0003284 Homo sapiens miR-616-5p
acucaaaacccuucagugacuu

SEQ ID NO: 1925 - RNA, 19 nt, Artificial sequence
  >hsa-miR-6165 MIMAT0024782 Homo sapiens miR-6165
cagcaggaggugaggggag

SEQ ID NO: 1926 - RNA, 22 nt, Artificial sequence
  >hsa-miR-617 MIMAT0003286 Homo sapiens miR-617
agacuucccauuugaagguggc

SEQ ID NO: 1927 - RNA, 23 nt, Artificial sequence
  >hsa-miR-618 MIMAT0003287 Homo sapiens miR-618
aaacucuacuuguccuucugagu

SEQ ID NO: 1928 - RNA, 24 nt, Artificial sequence
  >hsa-miR-619-3p MIMAT0003288 Homo sapiens miR-619-3p
gaccuggacauguuugugcccagu

SEQ ID NO: 1929 - RNA, 22 nt, Artificial sequence
  >hsa-miR-619-5p MIMAT0026622 Homo sapiens miR-619-5p
gcugggauuacaggcaugagcc

SEQ ID NO: 1930 - RNA, 20 nt, Artificial sequence
  >hsa-miR-620 MIMAT0003289 Homo sapiens miR-620
auggagauagauauagaaau

SEQ ID NO: 1931 - RNA, 21 nt, Artificial sequence
  >hsa-miR-621 MIMAT0003290 Homo sapiens miR-621
ggcuagcaacagcgcuuaccu

SEQ ID NO: 1932 - RNA, 21 nt, Artificial sequence
  >hsa-miR-622 MIMAT0003291 Homo sapiens miR-622
acagucugcugagguuggagc

SEQ ID NO: 1933 - RNA, 23 nt, Artificial sequence
  >hsa-miR-623 MIMAT0003292 Homo sapiens miR-623
aucccuugcaggggcuguugggu

SEQ ID NO: 1934 - RNA, 21 nt, Artificial sequence
  >hsa-miR-624-3p MIMAT0004807 Homo sapiens miR-624-3p
cacaagguauugguauuaccu

SEQ ID NO: 1935 - RNA, 22 nt, Artificial sequence
  >hsa-miR-624-5p MIMAT0003293 Homo sapiens miR-624-5p
uaguaccaguaccuuguguuca

SEQ ID NO: 1936 - RNA, 22 nt, Artificial sequence
  >hsa-miR-625-3p MIMAT0004808 Homo sapiens miR-625-3p
gacuauagaacuuucccccuca

SEQ ID NO: 1937 - RNA, 21 nt, Artificial sequence
  >hsa-miR-625-5p MIMAT0003294 Homo sapiens miR-625-5p
agggggaaaguucuauagucc

SEQ ID NO: 1938 - RNA, 19 nt, Artificial sequence
  >hsa-miR-626 MIMAT0003295 Homo sapiens miR-626
agcugucugaaaaugucuu

SEQ ID NO: 1939 - RNA, 20 nt, Artificial sequence
  >hsa-miR-627-3p MIMAT0026623 Homo sapiens miR-627-3p
ucuuuucuuugagacucacu

SEQ ID NO: 1940 - RNA, 22 nt, Artificial sequence
  >hsa-miR-627-5p MIMAT0003296 Homo sapiens miR-627-5p
gugagucucuaagaaaagagga

SEQ ID NO: 1941 - RNA, 21 nt, Artificial sequence
  >hsa-miR-628-3p MIMAT0003297 Homo sapiens miR-628-3p
ucuaguaagaguggcagucga

SEQ ID NO: 1942 - RNA, 22 nt, Artificial sequence
  >hsa-miR-628-5p MIMAT0004809 Homo sapiens miR-628-5p
augcugacauauuuacuagagg

SEQ ID NO: 1943 - RNA, 22 nt, Artificial sequence
  >hsa-miR-629-3p MIMAT0003298 Homo sapiens miR-629-3p
guucucccaacguaagcccagc

SEQ ID NO: 1944 - RNA, 21 nt, Artificial sequence
  >hsa-miR-629-5p MIMAT0004810 Homo sapiens miR-629-5p
uggguuuacguugggagaacu

SEQ ID NO: 1945 - RNA, 22 nt, Artificial sequence
  >hsa-miR-630 MIMAT0003299 Homo sapiens miR-630
aguauucuguaccagggaaggu

SEQ ID NO: 1946 - RNA, 21 nt, Artificial sequence
  >hsa-miR-631 MIMAT0003300 Homo sapiens miR-631
agaccuggcccagaccucagc

SEQ ID NO: 1947 - RNA, 19 nt, Artificial sequence
  >hsa-miR-632 MIMAT0003302 Homo sapiens miR-632
gugucugcuuccuguggga

SEQ ID NO: 1948 - RNA, 23 nt, Artificial sequence
  >hsa-miR-633 MIMAT0003303 Homo sapiens miR-633
cuaauaguaucuaccacaauaaa

SEQ ID NO: 1949 - RNA, 22 nt, Artificial sequence
  >hsa-miR-634 MIMAT0003304 Homo sapiens miR-634
aaccagcaccccaacuuuggac

SEQ ID NO: 1950 - RNA, 23 nt, Artificial sequence
  >hsa-miR-635 MIMAT0003305 Homo sapiens miR-635
acuugggcacugaaacaaugucc

SEQ ID NO: 1951 - RNA, 23 nt, Artificial sequence
  >hsa-miR-636 MIMAT0003306 Homo sapiens miR-636
ugugcuugcucgucccgcccgca

SEQ ID NO: 1952 - RNA, 24 nt, Artificial sequence
  >hsa-miR-637 MIMAT0003307 Homo sapiens miR-637
acugggggcuuucgggcucugcgu

SEQ ID NO: 1953 - RNA, 25 nt, Artificial sequence
  >hsa-miR-638 MIMAT0003308 Homo sapiens miR-638
agggaucgcgggcggguggcggccu

SEQ ID NO: 1954 - RNA, 23 nt, Artificial sequence
  >hsa-miR-639 MIMAT0003309 Homo sapiens miR-639
aucgcugcgguugcgagcgcugu

SEQ ID NO: 1955 - RNA, 21 nt, Artificial sequence
  >hsa-miR-640 MIMAT0003310 Homo sapiens miR-640
augauccaggaaccugccucu

SEQ ID NO: 1956 - RNA, 24 nt, Artificial sequence
  >hsa-miR-641 MIMAT0003311 Homo sapiens miR-641
aaagacauaggauagagucaccuc

SEQ ID NO: 1957 - RNA, 22 nt, Artificial sequence
  >hsa-miR-642a-3p MIMAT0020924 Homo sapiens miR-642a-3p
agacacauuuggagagggaacc

SEQ ID NO: 1958 - RNA, 22 nt, Artificial sequence
  >hsa-miR-642a-5p MIMAT0003312 Homo sapiens miR-642a-5p
gucccucuccaaaugugucuug

SEQ ID NO: 1959 - RNA, 22 nt, Artificial sequence
  >hsa-miR-642b-3p MIMAT0018444 Homo sapiens miR-642b-3p
agacacauuuggagagggaccc

SEQ ID NO: 1960 - RNA, 22 nt, Artificial sequence
  >hsa-miR-642b-5p MIMAT0022736 Homo sapiens miR-642b-5p
gguucccucuccaaaugugucu

SEQ ID NO: 1961 - RNA, 22 nt, Artificial sequence
  >hsa-miR-643 MIMAT0003313 Homo sapiens miR-643
acuuguaugcuagcucagguag

SEQ ID NO: 1962 - RNA, 19 nt, Artificial sequence
  >hsa-miR-644a MIMAT0003314 Homo sapiens miR-644a
aguguggcuuucuuagagc

SEQ ID NO: 1963 - RNA, 19 nt, Artificial sequence
  >hsa-miR-645 MIMAT0003315 Homo sapiens miR-645
ucuaggcugguacugcuga

SEQ ID NO: 1964 - RNA, 19 nt, Artificial sequence
  >hsa-miR-646 MIMAT0003316 Homo sapiens miR-646
aagcagcugccucugaggc

SEQ ID NO: 1965 - RNA, 21 nt, Artificial sequence
  >hsa-miR-647 MIMAT0003317 Homo sapiens miR-647
guggcugcacucacuuccuuc

SEQ ID NO: 1966 - RNA, 19 nt, Artificial sequence
  >hsa-miR-648 MIMAT0003318 Homo sapiens miR-648
aagugugcagggcacuggu

SEQ ID NO: 1967 - RNA, 22 nt, Artificial sequence
  >hsa-miR-649 MIMAT0003319 Homo sapiens miR-649
aaaccuguguuguucaagaguc

SEQ ID NO: 1968 - RNA, 22 nt, Artificial sequence
  >hsa-miR-6499-3p MIMAT0025451 Homo sapiens miR-6499-3p
agcaguguuuguuuugcccaca

SEQ ID NO: 1969 - RNA, 22 nt, Artificial sequence
  >hsa-miR-6499-5p MIMAT0025450 Homo sapiens miR-6499-5p
ucgggcgcaagagcacugcagu

SEQ ID NO: 1970 - RNA, 21 nt, Artificial sequence
  >hsa-miR-650 MIMAT0003320 Homo sapiens miR-650
aggaggcagcgcucucaggac

SEQ ID NO: 1971 - RNA, 21 nt, Artificial sequence
  >hsa-miR-6500-3p MIMAT0025455 Homo sapiens miR-6500-3p
acacuuguugggaugaccugc

SEQ ID NO: 1972 - RNA, 24 nt, Artificial sequence
  >hsa-miR-6500-5p MIMAT0025454 Homo sapiens miR-6500-5p
aggagcuauccacuccaggugucc

SEQ ID NO: 1973 - RNA, 23 nt, Artificial sequence
  >hsa-miR-6501-3p MIMAT0025459 Homo sapiens miR-6501-3p
ccagagcagccugcgguaacagu

SEQ ID NO: 1974 - RNA, 22 nt, Artificial sequence
  >hsa-miR-6501-5p MIMAT0025458 Homo sapiens miR-6501-5p
aguugccagggcugccuuuggu

SEQ ID NO: 1975 - RNA, 21 nt, Artificial sequence
  >hsa-miR-6502-3p MIMAT0025461 Homo sapiens miR-6502-3p
uagaccaucuuucuagaguau

SEQ ID NO: 1976 - RNA, 22 nt, Artificial sequence
  >hsa-miR-6502-5p MIMAT0025460 Homo sapiens miR-6502-5p
agcucuagaaagauuguugacc

SEQ ID NO: 1977 - RNA, 21 nt, Artificial sequence
  >hsa-miR-6503-3p MIMAT0025463 Homo sapiens miR-6503-3p
gggacuaggaugcagaccucc

SEQ ID NO: 1978 - RNA, 23 nt, Artificial sequence
  >hsa-miR-6503-5p MIMAT0025462 Homo sapiens miR-6503-5p
aggucugcauucaaauccccaga

SEQ ID NO: 1979 - RNA, 20 nt, Artificial sequence
  >hsa-miR-6504-3p MIMAT0025465 Homo sapiens miR-6504-3p
cauuacagcacagccauucu

SEQ ID NO: 1980 - RNA, 21 nt, Artificial sequence
  >hsa-miR-6504-5p MIMAT0025464 Homo sapiens miR-6504-5p
ucuggcugugcuguaaugcag

SEQ ID NO: 1981 - RNA, 21 nt, Artificial sequence
  >hsa-miR-6505-3p MIMAT0025467 Homo sapiens miR-6505-3p
ugacuucuaccucuuccaaag

SEQ ID NO: 1982 - RNA, 22 nt, Artificial sequence
  >hsa-miR-6505-5p MIMAT0025466 Homo sapiens miR-6505-5p
uuggaauaggggauaucucagc

SEQ ID NO: 1983 - RNA, 22 nt, Artificial sequence
  >hsa-miR-6506-3p MIMAT0025469 Homo sapiens miR-6506-3p
ucguaucagagauuccagacac

SEQ ID NO: 1984 - RNA, 23 nt, Artificial sequence
  >hsa-miR-6506-5p MIMAT0025468 Homo sapiens miR-6506-5p
acugggaugucacugaauauggu

SEQ ID NO: 1985 - RNA, 22 nt, Artificial sequence
  >hsa-miR-6507-3p MIMAT0025471 Homo sapiens miR-6507-3p
caaaguccuuccuauuuuuccc

SEQ ID NO: 1986 - RNA, 21 nt, Artificial sequence
  >hsa-miR-6507-5p MIMAT0025470 Homo sapiens miR-6507-5p
gaagaauaggagggacuuugu

SEQ ID NO: 1987 - RNA, 22 nt, Artificial sequence
  >hsa-miR-6508-3p MIMAT0025473 Homo sapiens miR-6508-3p
ugggccaugcauuucuagaacu

SEQ ID NO: 1988 - RNA, 21 nt, Artificial sequence
  >hsa-miR-6508-5p MIMAT0025472 Homo sapiens miR-6508-5p
ucuagaaaugcaugacccacc

SEQ ID NO: 1989 - RNA, 22 nt, Artificial sequence
  >hsa-miR-6509-3p MIMAT0025475 Homo sapiens miR-6509-3p
uuccacugccacuaccuaauuu

SEQ ID NO: 1990 - RNA, 21 nt, Artificial sequence
  >hsa-miR-6509-5p MIMAT0025474 Homo sapiens miR-6509-5p
auuagguaguggcaguggaac

SEQ ID NO: 1991 - RNA, 22 nt, Artificial sequence
  >hsa-miR-651-3p MIMAT0026624 Homo sapiens miR-651-3p
aaaggaaaguguauccuaaaag

SEQ ID NO: 1992 - RNA, 22 nt, Artificial sequence
  >hsa-miR-651-5p MIMAT0003321 Homo sapiens miR-651-5p
uuuaggauaagcuugacuuuug

SEQ ID NO: 1993 - RNA, 21 nt, Artificial sequence
  >hsa-miR-6510-3p MIMAT0025477 Homo sapiens miR-6510-3p
caccgacucugucuccugcag

SEQ ID NO: 1994 - RNA, 22 nt, Artificial sequence
  >hsa-miR-6510-5p MIMAT0025476 Homo sapiens miR-6510-5p
cagcaggggagagagaggaguc

SEQ ID NO: 1995 - RNA, 22 nt, Artificial sequence
  >hsa-miR-6511a-3p MIMAT0025479 Homo sapiens miR-6511a-3p
ccucaccaucccuucugccugc

SEQ ID NO: 1996 - RNA, 23 nt, Artificial sequence
  >hsa-miR-6511a-5p MIMAT0025478 Homo sapiens miR-6511a-5p
caggcagaaguggggcugacagg

SEQ ID NO: 1997 - RNA, 23 nt, Artificial sequence
  >hsa-miR-6511b-3p MIMAT0025848 Homo sapiens miR-6511b-3p
ccucaccaccccuucugccugca

SEQ ID NO: 1998 - RNA, 24 nt, Artificial sequence
  >hsa-miR-6511b-5p MIMAT0025847 Homo sapiens miR-6511b-5p
cugcaggcagaaguggggcugaca

SEQ ID NO: 1999 - RNA, 22 nt, Artificial sequence
  >hsa-miR-6512-3p MIMAT0025481 Homo sapiens miR-6512-3p
uuccagcccuucuaaugguagg

SEQ ID NO: 2000 - RNA, 22 nt, Artificial sequence
  >hsa-miR-6512-5p MIMAT0025480 Homo sapiens miR-6512-5p
uaccauuagaagagcuggaaga

SEQ ID NO: 2001 - RNA, 21 nt, Artificial sequence
  >hsa-miR-6513-3p MIMAT0025483 Homo sapiens miR-6513-3p
ucaagugucaucugucccuag

SEQ ID NO: 2002 - RNA, 23 nt, Artificial sequence
  >hsa-miR-6513-5p MIMAT0025482 Homo sapiens miR-6513-5p
uuugggauugacgccacaugucu

SEQ ID NO: 2003 - RNA, 21 nt, Artificial sequence
  >hsa-miR-6514-3p MIMAT0025485 Homo sapiens miR-6514-3p
cugccuguucuuccacuccag

SEQ ID NO: 2004 - RNA, 23 nt, Artificial sequence
  >hsa-miR-6514-5p MIMAT0025484 Homo sapiens miR-6514-5p
uauggaguggacuuucagcuggc

SEQ ID NO: 2005 - RNA, 20 nt, Artificial sequence
  >hsa-miR-6515-3p MIMAT0025487 Homo sapiens miR-6515-3p
ucucuucaucuaccccccag

SEQ ID NO: 2006 - RNA, 21 nt, Artificial sequence
  >hsa-miR-6515-5p MIMAT0025486 Homo sapiens miR-6515-5p
uuggaggguguggaagacauc

SEQ ID NO: 2007 - RNA, 22 nt, Artificial sequence
  >hsa-miR-6516-3p MIMAT0030418 Homo sapiens miR-6516-3p
aucauguaugauacugcaaaca

SEQ ID NO: 2008 - RNA, 22 nt, Artificial sequence
  >hsa-miR-6516-5p MIMAT0030417 Homo sapiens miR-6516-5p
uuugcaguaacaggugugagca

SEQ ID NO: 2009 - RNA, 21 nt, Artificial sequence
  >hsa-miR-652-3p MIMAT0003322 Homo sapiens miR-652-3p
aauggcgccacuaggguugug

SEQ ID NO: 2010 - RNA, 25 nt, Artificial sequence
  >hsa-miR-652-5p MIMAT0022709 Homo sapiens miR-652-5p
caacccuaggagagggugccauuca

SEQ ID NO: 2011 - RNA, 22 nt, Artificial sequence
  >hsa-miR-653-3p MIMAT0026625 Homo sapiens miR-653-3p
uucacuggaguuuguuucaaua

SEQ ID NO: 2012 - RNA, 21 nt, Artificial sequence
  >hsa-miR-653-5p MIMAT0003328 Homo sapiens miR-653-5p
guguugaaacaaucucuacug

SEQ ID NO: 2013 - RNA, 22 nt, Artificial sequence
  >hsa-miR-654-3p MIMAT0004814 Homo sapiens miR-654-3p
uaugucugcugaccaucaccuu

SEQ ID NO: 2014 - RNA, 22 nt, Artificial sequence
  >hsa-miR-654-5p MIMAT0003330 Homo sapiens miR-654-5p
uggugggccgcagaacaugugc

SEQ ID NO: 2015 - RNA, 22 nt, Artificial sequence
  >hsa-miR-655-3p MIMAT0003331 Homo sapiens miR-655-3p
auaauacaugguuaaccucuuu

SEQ ID NO: 2016 - RNA, 22 nt, Artificial sequence
  >hsa-miR-655-5p MIMAT0026626 Homo sapiens miR-655-5p
agagguuauccguguuauguuc

SEQ ID NO: 2017 - RNA, 21 nt, Artificial sequence
  >hsa-miR-656-3p MIMAT0003332 Homo sapiens miR-656-3p
aauauuauacagucaaccucu

SEQ ID NO: 2018 - RNA, 21 nt, Artificial sequence
  >hsa-miR-656-5p MIMAT0026627 Homo sapiens miR-656-5p
agguugccugugagguguuca

SEQ ID NO: 2019 - RNA, 23 nt, Artificial sequence
  >hsa-miR-657 MIMAT0003335 Homo sapiens miR-657
ggcagguucucacccucucuagg

SEQ ID NO: 2020 - RNA, 25 nt, Artificial sequence
  >hsa-miR-658 MIMAT0003336 Homo sapiens miR-658
ggcggagggaaguagguccguuggu

SEQ ID NO: 2021 - RNA, 22 nt, Artificial sequence
  >hsa-miR-659-3p MIMAT0003337 Homo sapiens miR-659-3p
cuugguucagggagggucccca

SEQ ID NO: 2022 - RNA, 22 nt, Artificial sequence
  >hsa-miR-659-5p MIMAT0022710 Homo sapiens miR-659-5p
aggaccuucccugaaccaagga

SEQ ID NO: 2023 - RNA, 21 nt, Artificial sequence
  >hsa-miR-660-3p MIMAT0022711 Homo sapiens miR-660-3p
accuccugugugcauggauua

SEQ ID NO: 2024 - RNA, 22 nt, Artificial sequence
  >hsa-miR-660-5p MIMAT0003338 Homo sapiens miR-660-5p
uacccauugcauaucggaguug

SEQ ID NO: 2025 - RNA, 24 nt, Artificial sequence
  >hsa-miR-661 MIMAT0003324 Homo sapiens miR-661
ugccugggucucuggccugcgcgu

SEQ ID NO: 2026 - RNA, 21 nt, Artificial sequence
  >hsa-miR-662 MIMAT0003325 Homo sapiens miR-662
ucccacguuguggcccagcag

SEQ ID NO: 2027 - RNA, 22 nt, Artificial sequence
  >hsa-miR-663a MIMAT0003326 Homo sapiens miR-663a
aggcggggcgccgcgggaccgc

SEQ ID NO: 2028 - RNA, 22 nt, Artificial sequence
  >hsa-miR-663b MIMAT0005867 Homo sapiens miR-663b
gguggcccggccgugccugagg

SEQ ID NO: 2029 - RNA, 23 nt, Artificial sequence
  >hsa-miR-664a-3p MIMAT0005949 Homo sapiens miR-664a-3p
uauucauuuauccccagccuaca

SEQ ID NO: 2030 - RNA, 24 nt, Artificial sequence
  >hsa-miR-664a-5p MIMAT0005948 Homo sapiens miR-664a-5p
acuggcuagggaaaaugauuggau

SEQ ID NO: 2031 - RNA, 22 nt, Artificial sequence
  >hsa-miR-664b-3p MIMAT0022272 Homo sapiens miR-664b-3p
uucauuugccucccagccuaca

SEQ ID NO: 2032 - RNA, 24 nt, Artificial sequence
  >hsa-miR-664b-5p MIMAT0022271 Homo sapiens miR-664b-5p
ugggcuaagggagaugauugggua

SEQ ID NO: 2033 - RNA, 20 nt, Artificial sequence
  >hsa-miR-665 MIMAT0004952 Homo sapiens miR-665
accaggaggcugaggccccu

SEQ ID NO: 2034 - RNA, 23 nt, Artificial sequence
  >hsa-miR-668-3p MIMAT0003881 Homo sapiens miR-668-3p
ugucacucggcucggcccacuac

SEQ ID NO: 2035 - RNA, 19 nt, Artificial sequence
  >hsa-miR-668-5p MIMAT0026636 Homo sapiens miR-668-5p
ugcgccucgggugagcaug

SEQ ID NO: 2036 - RNA, 21 nt, Artificial sequence
  >hsa-miR-670-3p MIMAT0026640 Homo sapiens miR-670-3p
uuuccucauauucauucagga

SEQ ID NO: 2037 - RNA, 20 nt, Artificial sequence
  >hsa-miR-670-5p MIMAT0010357 Homo sapiens miR-670-5p
gucccugaguguauguggug

SEQ ID NO: 2038 - RNA, 21 nt, Artificial sequence
  >hsa-miR-671-3p MIMAT0004819 Homo sapiens miR-671-3p
uccgguucucagggcuccacc

SEQ ID NO: 2039 - RNA, 23 nt, Artificial sequence
  >hsa-miR-671-5p MIMAT0003880 Homo sapiens miR-671-5p
aggaagcccuggaggggcuggag

SEQ ID NO: 2040 - RNA, 21 nt, Artificial sequence
  >hsa-miR-6715a-3p MIMAT0025841 Homo sapiens miR-6715a-3p
ccaaaccagucgugccugugg

SEQ ID NO: 2041 - RNA, 22 nt, Artificial sequence
  >hsa-miR-6715b-3p MIMAT0025843 Homo sapiens miR-6715b-3p
cucaaaccggcugugccugugg

SEQ ID NO: 2042 - RNA, 21 nt, Artificial sequence
  >hsa-miR-6715b-5p MIMAT0025842 Homo sapiens miR-6715b-5p
acaggcacgacugguuuggca

SEQ ID NO: 2043 - RNA, 22 nt, Artificial sequence
  >hsa-miR-6716-3p MIMAT0025845 Homo sapiens miR-6716-3p
uccgaacucuccauuccucugc

SEQ ID NO: 2044 - RNA, 20 nt, Artificial sequence
  >hsa-miR-6716-5p MIMAT0025844 Homo sapiens miR-6716-5p
ugggaauggggguaagggcc

SEQ ID NO: 2045 - RNA, 22 nt, Artificial sequence
  >hsa-miR-6717-5p MIMAT0025846 Homo sapiens miR-6717-5p
aggcgauguggggauguagaga

SEQ ID NO: 2046 - RNA, 21 nt, Artificial sequence
  >hsa-miR-6718-5p MIMAT0025849 Homo sapiens miR-6718-5p
uaguggucagagggcuuauga

SEQ ID NO: 2047 - RNA, 22 nt, Artificial sequence
  >hsa-miR-6719-3p MIMAT0025850 Homo sapiens miR-6719-3p
ucugacaucagugauucuccug

SEQ ID NO: 2048 - RNA, 22 nt, Artificial sequence
  >hsa-miR-6720-3p MIMAT0025851 Homo sapiens miR-6720-3p
cgcgccugcaggaacugguaga

SEQ ID NO: 2049 - RNA, 23 nt, Artificial sequence
  >hsa-miR-6720-5p MIMAT0027345 Homo sapiens miR-6720-5p
uuccagcccugguaggcgccgcg

SEQ ID NO: 2050 - RNA, 23 nt, Artificial sequence
  >hsa-miR-6721-5p MIMAT0025852 Homo sapiens miR-6721-5p
ugggcaggggcuuauuguaggag

SEQ ID NO: 2051 - RNA, 22 nt, Artificial sequence
  >hsa-miR-6722-3p MIMAT0025854 Homo sapiens miR-6722-3p
ugcaggggucgggugggccagg

SEQ ID NO: 2052 - RNA, 20 nt, Artificial sequence
  >hsa-miR-6722-5p MIMAT0025853 Homo sapiens miR-6722-5p
aggcgcacccgaccacaugc

SEQ ID NO: 2053 - RNA, 22 nt, Artificial sequence
  >hsa-miR-6723-5p MIMAT0025855 Homo sapiens miR-6723-5p
auaguccgaguaacgucggggc

SEQ ID NO: 2054 - RNA, 23 nt, Artificial sequence
  >hsa-miR-6724-5p MIMAT0025856 Homo sapiens miR-6724-5p
cugggcccgcggcgggcgugggg

SEQ ID NO: 2055 - RNA, 20 nt, Artificial sequence
  >hsa-miR-6726-3p MIMAT0027354 Homo sapiens miR-6726-3p
cucgcccugucucccgcuag

SEQ ID NO: 2056 - RNA, 21 nt, Artificial sequence
  >hsa-miR-6726-5p MIMAT0027353 Homo sapiens miR-6726-5p
cgggagcuggggucugcaggu

SEQ ID NO: 2057 - RNA, 20 nt, Artificial sequence
  >hsa-miR-6727-3p MIMAT0027356 Homo sapiens miR-6727-3p
uccugccaccuccuccgcag

SEQ ID NO: 2058 - RNA, 23 nt, Artificial sequence
  >hsa-miR-6727-5p MIMAT0027355 Homo sapiens miR-6727-5p
cucggggcaggcggcugggagcg

SEQ ID NO: 2059 - RNA, 21 nt, Artificial sequence
  >hsa-miR-6728-3p MIMAT0027358 Homo sapiens miR-6728-3p
ucucugcucugcucuccccag

SEQ ID NO: 2060 - RNA, 23 nt, Artificial sequence
  >hsa-miR-6728-5p MIMAT0027357 Homo sapiens miR-6728-5p
uugggaugguaggaccagagggg

SEQ ID NO: 2061 - RNA, 21 nt, Artificial sequence
  >hsa-miR-6729-3p MIMAT0027360 Homo sapiens miR-6729-3p
ucaucccccucgcccucucag

SEQ ID NO: 2062 - RNA, 22 nt, Artificial sequence
  >hsa-miR-6729-5p MIMAT0027359 Homo sapiens miR-6729-5p
ugggcgagggcggcugagcggc

SEQ ID NO: 2063 - RNA, 22 nt, Artificial sequence
  >hsa-miR-6730-3p MIMAT0027362 Homo sapiens miR-6730-3p
ccugacaccccaucugcccuca

SEQ ID NO: 2064 - RNA, 23 nt, Artificial sequence
  >hsa-miR-6730-5p MIMAT0027361 Homo sapiens miR-6730-5p
agaaagguggagggguugucaga

SEQ ID NO: 2065 - RNA, 21 nt, Artificial sequence
  >hsa-miR-6731-3p MIMAT0027364 Homo sapiens miR-6731-3p
ucuauuccccacucuccccag

SEQ ID NO: 2066 - RNA, 22 nt, Artificial sequence
  >hsa-miR-6731-5p MIMAT0027363 Homo sapiens miR-6731-5p
ugggagagcaggguauugugga

SEQ ID NO: 2067 - RNA, 23 nt, Artificial sequence
  >hsa-miR-6732-3p MIMAT0027366 Homo sapiens miR-6732-3p
uaacccuguccucucccucccag

SEQ ID NO: 2068 - RNA, 20 nt, Artificial sequence
  >hsa-miR-6732-5p MIMAT0027365 Homo sapiens miR-6732-5p
uaggggguggcaggcuggcc

SEQ ID NO: 2069 - RNA, 20 nt, Artificial sequence
  >hsa-miR-6733-3p MIMAT0027368 Homo sapiens miR-6733-3p
ucagugucuggauuuccuag

SEQ ID NO: 2070 - RNA, 22 nt, Artificial sequence
  >hsa-miR-6733-5p MIMAT0027367 Homo sapiens miR-6733-5p
ugggaaagacaaacucagaguu

SEQ ID NO: 2071 - RNA, 23 nt, Artificial sequence
  >hsa-miR-6734-3p MIMAT0027370 Homo sapiens miR-6734-3p
cccuucccucacucuucucucag

SEQ ID NO: 2072 - RNA, 23 nt, Artificial sequence
  >hsa-miR-6734-5p MIMAT0027369 Homo sapiens miR-6734-5p
uugaggggagaaugagguggaga

SEQ ID NO: 2073 - RNA, 22 nt, Artificial sequence
  >hsa-miR-6735-3p MIMAT0027372 Homo sapiens miR-6735-3p
aggccuguggcuccucccucag

SEQ ID NO: 2074 - RNA, 25 nt, Artificial sequence
  >hsa-miR-6735-5p MIMAT0027371 Homo sapiens miR-6735-5p
cagggcagagggcacaggaaucuga

SEQ ID NO: 2075 - RNA, 21 nt, Artificial sequence
  >hsa-miR-6736-3p MIMAT0027374 Homo sapiens miR-6736-3p
ucagcuccucucuacccacag

SEQ ID NO: 2076 - RNA, 21 nt, Artificial sequence
  >hsa-miR-6736-5p MIMAT0027373 Homo sapiens miR-6736-5p
cugggugagggcaucuguggu

SEQ ID NO: 2077 - RNA, 22 nt, Artificial sequence
  >hsa-miR-6737-3p MIMAT0027376 Homo sapiens miR-6737-3p
ucugugcuucaccccuacccag

SEQ ID NO: 2078 - RNA, 21 nt, Artificial sequence
  >hsa-miR-6737-5p MIMAT0027375 Homo sapiens miR-6737-5p
uugggguggucggcccuggag

SEQ ID NO: 2079 - RNA, 24 nt, Artificial sequence
  >hsa-miR-6738-3p MIMAT0027378 Homo sapiens miR-6738-3p
cuucugccugcauucuacucccag

SEQ ID NO: 2080 - RNA, 23 nt, Artificial sequence
  >hsa-miR-6738-5p MIMAT0027377 Homo sapiens miR-6738-5p
cgagggguagaagagcacagggg

SEQ ID NO: 2081 - RNA, 21 nt, Artificial sequence
  >hsa-miR-6739-3p MIMAT0027380 Homo sapiens miR-6739-3p
auuguucugucuuucucccag

SEQ ID NO: 2082 - RNA, 22 nt, Artificial sequence
  >hsa-miR-6739-5p MIMAT0027379 Homo sapiens miR-6739-5p
ugggaaagagaaagaacaagua

SEQ ID NO: 2083 - RNA, 22 nt, Artificial sequence
  >hsa-miR-6740-3p MIMAT0027382 Homo sapiens miR-6740-3p
ugucuucucuccucccaaacag

SEQ ID NO: 2084 - RNA, 22 nt, Artificial sequence
  >hsa-miR-6740-5p MIMAT0027381 Homo sapiens miR-6740-5p
aguuugggauggagagaggaga

SEQ ID NO: 2085 - RNA, 22 nt, Artificial sequence
  >hsa-miR-6741-3p MIMAT0027384 Homo sapiens miR-6741-3p
ucggcucucucccucacccuag

SEQ ID NO: 2086 - RNA, 22 nt, Artificial sequence
  >hsa-miR-6741-5p MIMAT0027383 Homo sapiens miR-6741-5p
gugggugcuggugggagccgug

SEQ ID NO: 2087 - RNA, 20 nt, Artificial sequence
  >hsa-miR-6742-3p MIMAT0027386 Homo sapiens miR-6742-3p
accuggguuguccccucuag

SEQ ID NO: 2088 - RNA, 22 nt, Artificial sequence
  >hsa-miR-6742-5p MIMAT0027385 Homo sapiens miR-6742-5p
aguggggugggacccagcuguu

SEQ ID NO: 2089 - RNA, 23 nt, Artificial sequence
  >hsa-miR-6743-3p MIMAT0027388 Homo sapiens miR-6743-3p
agccgcucuucucccugcccaca

SEQ ID NO: 2090 - RNA, 22 nt, Artificial sequence
  >hsa-miR-6743-5p MIMAT0027387 Homo sapiens miR-6743-5p
aaggggcagggacggguggccc

SEQ ID NO: 2091 - RNA, 23 nt, Artificial sequence
  >hsa-miR-6744-3p MIMAT0027390 Homo sapiens miR-6744-3p
gggccucucuugucauccugcag

SEQ ID NO: 2092 - RNA, 19 nt, Artificial sequence
  >hsa-miR-6744-5p MIMAT0027389 Homo sapiens miR-6744-5p
uggaugacaguggaggccu

SEQ ID NO: 2093 - RNA, 21 nt, Artificial sequence
  >hsa-miR-6745 MIMAT0027391 Homo sapiens miR-6745
uggguggaagaaggucugguu

SEQ ID NO: 2094 - RNA, 22 nt, Artificial sequence
  >hsa-miR-6746-3p MIMAT0027393 Homo sapiens miR-6746-3p
cagccgccgccugucuccacag

SEQ ID NO: 2095 - RNA, 22 nt, Artificial sequence
  >hsa-miR-6746-5p MIMAT0027392 Homo sapiens miR-6746-5p
ccgggagaaggagguggccugg

SEQ ID NO: 2096 - RNA, 21 nt, Artificial sequence
  >hsa-miR-6747-3p MIMAT0027395 Homo sapiens miR-6747-3p
uccugccuuccucugcaccag

SEQ ID NO: 2097 - RNA, 24 nt, Artificial sequence
  >hsa-miR-6747-5p MIMAT0027394 Homo sapiens miR-6747-5p
agggguguggaaagaggcagaaca

SEQ ID NO: 2098 - RNA, 21 nt, Artificial sequence
  >hsa-miR-6748-3p MIMAT0027397 Homo sapiens miR-6748-3p
uccugucccugucuccuacag

SEQ ID NO: 2099 - RNA, 22 nt, Artificial sequence
  >hsa-miR-6748-5p MIMAT0027396 Homo sapiens miR-6748-5p
ugugggugggaaggacuggauu

SEQ ID NO: 2100 - RNA, 21 nt, Artificial sequence
  >hsa-miR-6749-3p MIMAT0027399 Homo sapiens miR-6749-3p
cuccuccccugccuggcccag

SEQ ID NO: 2101 - RNA, 22 nt, Artificial sequence
  >hsa-miR-6749-5p MIMAT0027398 Homo sapiens miR-6749-5p
ucgggccugggguugggggagc

SEQ ID NO: 2102 - RNA, 20 nt, Artificial sequence
  >hsa-miR-675-3p MIMAT0006790 Homo sapiens miR-675-3p
cuguaugcccucaccgcuca

SEQ ID NO: 2103 - RNA, 23 nt, Artificial sequence
  >hsa-miR-675-5p MIMAT0004284 Homo sapiens miR-675-5p
uggugcggagagggcccacagug

SEQ ID NO: 2104 - RNA, 21 nt, Artificial sequence
  >hsa-miR-6750-3p MIMAT0027401 Homo sapiens miR-6750-3p
gaacucacccucugcucccag

SEQ ID NO: 2105 - RNA, 24 nt, Artificial sequence
  >hsa-miR-6750-5p MIMAT0027400 Homo sapiens miR-6750-5p
cagggaacagcugggugagcugcu

SEQ ID NO: 2106 - RNA, 21 nt, Artificial sequence
  >hsa-miR-6751-3p MIMAT0027403 Homo sapiens miR-6751-3p
acugagccucucucucuccag

SEQ ID NO: 2107 - RNA, 23 nt, Artificial sequence
  >hsa-miR-6751-5p MIMAT0027402 Homo sapiens miR-6751-5p
uugggggugagguuggugucugg

SEQ ID NO: 2108 - RNA, 21 nt, Artificial sequence
  >hsa-miR-6752-3p MIMAT0027405 Homo sapiens miR-6752-3p
ucccugcccccauacucccag

SEQ ID NO: 2109 - RNA, 22 nt, Artificial sequence
  >hsa-miR-6752-5p MIMAT0027404 Homo sapiens miR-6752-5p
gggggguguggagccagggggc

SEQ ID NO: 2110 - RNA, 22 nt, Artificial sequence
  >hsa-miR-6753-3p MIMAT0027407 Homo sapiens miR-6753-3p
uggucugucucugcccuggcac

SEQ ID NO: 2111 - RNA, 22 nt, Artificial sequence
  >hsa-miR-6753-5p MIMAT0027406 Homo sapiens miR-6753-5p
caccagggcagagcagggcuga

SEQ ID NO: 2112 - RNA, 22 nt, Artificial sequence
  >hsa-miR-6754-3p MIMAT0027409 Homo sapiens miR-6754-3p
ucuucaccugccucugccugca

SEQ ID NO: 2113 - RNA, 22 nt, Artificial sequence
  >hsa-miR-6754-5p MIMAT0027408 Homo sapiens miR-6754-5p
ccagggaggcugguuuggagga

SEQ ID NO: 2114 - RNA, 22 nt, Artificial sequence
  >hsa-miR-6755-3p MIMAT0027411 Homo sapiens miR-6755-3p
uguugucauguuuuuucccuag

SEQ ID NO: 2115 - RNA, 22 nt, Artificial sequence
  >hsa-miR-6755-5p MIMAT0027410 Homo sapiens miR-6755-5p
uaggguagacacugacaacguu

SEQ ID NO: 2116 - RNA, 20 nt, Artificial sequence
  >hsa-miR-6756-3p MIMAT0027413 Homo sapiens miR-6756-3p
uccccuuccucccugcccag

SEQ ID NO: 2117 - RNA, 23 nt, Artificial sequence
  >hsa-miR-6756-5p MIMAT0027412 Homo sapiens miR-6756-5p
aggguggggcuggagguggggcu

SEQ ID NO: 2118 - RNA, 22 nt, Artificial sequence
  >hsa-miR-6757-3p MIMAT0027415 Homo sapiens miR-6757-3p
aacacuggccuugcuaucccca

SEQ ID NO: 2119 - RNA, 22 nt, Artificial sequence
  >hsa-miR-6757-5p MIMAT0027414 Homo sapiens miR-6757-5p
uagggaugggaggccaggauga

SEQ ID NO: 2120 - RNA, 20 nt, Artificial sequence
  >hsa-miR-6758-3p MIMAT0027417 Homo sapiens miR-6758-3p
acucauucuccucuguccag

SEQ ID NO: 2121 - RNA, 23 nt, Artificial sequence
  >hsa-miR-6758-5p MIMAT0027416 Homo sapiens miR-6758-5p
uagagaggggaaggaugugaugu

SEQ ID NO: 2122 - RNA, 22 nt, Artificial sequence
  >hsa-miR-6759-3p MIMAT0027419 Homo sapiens miR-6759-3p
ugaccuuugccucuccccucag

SEQ ID NO: 2123 - RNA, 22 nt, Artificial sequence
  >hsa-miR-6759-5p MIMAT0027418 Homo sapiens miR-6759-5p
uugugggugggcagaagucugu

SEQ ID NO: 2124 - RNA, 21 nt, Artificial sequence
  >hsa-miR-676-3p MIMAT0018204 Homo sapiens miR-676-3p
cuguccuaagguuguugaguu

SEQ ID NO: 2125 - RNA, 21 nt, Artificial sequence
  >hsa-miR-676-5p MIMAT0018203 Homo sapiens miR-676-5p
ucuucaaccucaggacuugca

SEQ ID NO: 2126 - RNA, 21 nt, Artificial sequence
  >hsa-miR-6760-3p MIMAT0027421 Homo sapiens miR-6760-3p
acacuguccccuucuccccag

SEQ ID NO: 2127 - RNA, 23 nt, Artificial sequence
  >hsa-miR-6760-5p MIMAT0027420 Homo sapiens miR-6760-5p
cagggagaagguggaagugcaga

SEQ ID NO: 2128 - RNA, 22 nt, Artificial sequence
  >hsa-miR-6761-3p MIMAT0027423 Homo sapiens miR-6761-3p
uccuacgcugcucucucacucc

SEQ ID NO: 2129 - RNA, 21 nt, Artificial sequence
  >hsa-miR-6761-5p MIMAT0027422 Homo sapiens miR-6761-5p
ucugagagagcucgauggcag

SEQ ID NO: 2130 - RNA, 23 nt, Artificial sequence
  >hsa-miR-6762-3p MIMAT0027425 Homo sapiens miR-6762-3p
uggcugcuucccuuggucuccag

SEQ ID NO: 2131 - RNA, 23 nt, Artificial sequence
  >hsa-miR-6762-5p MIMAT0027424 Homo sapiens miR-6762-5p
cggggccauggagcagccugugu

SEQ ID NO: 2132 - RNA, 21 nt, Artificial sequence
  >hsa-miR-6763-3p MIMAT0027427 Homo sapiens miR-6763-3p
cuccccggccucugcccccag

SEQ ID NO: 2133 - RNA, 19 nt, Artificial sequence
  >hsa-miR-6763-5p MIMAT0027426 Homo sapiens miR-6763-5p
cuggggaguggcuggggag

SEQ ID NO: 2134 - RNA, 21 nt, Artificial sequence
  >hsa-miR-6764-3p MIMAT0027429 Homo sapiens miR-6764-3p
ucucuggucuuuccuugacag

SEQ ID NO: 2135 - RNA, 22 nt, Artificial sequence
  >hsa-miR-6764-5p MIMAT0027428 Homo sapiens miR-6764-5p
ucccagggucuggucagaguug

SEQ ID NO: 2136 - RNA, 21 nt, Artificial sequence
  >hsa-miR-6765-3p MIMAT0027431 Homo sapiens miR-6765-3p
ucaccuggcuggcccgcccag

SEQ ID NO: 2137 - RNA, 25 nt, Artificial sequence
  >hsa-miR-6765-5p MIMAT0027430 Homo sapiens miR-6765-5p
gugaggcggggccaggagggugugu

SEQ ID NO: 2138 - RNA, 22 nt, Artificial sequence
  >hsa-miR-6766-3p MIMAT0027433 Homo sapiens miR-6766-3p
ugauugucuucccccacccuca

SEQ ID NO: 2139 - RNA, 24 nt, Artificial sequence
  >hsa-miR-6766-5p MIMAT0027432 Homo sapiens miR-6766-5p
cgggugggagcagaucuuauugag

SEQ ID NO: 2140 - RNA, 22 nt, Artificial sequence
  >hsa-miR-6767-3p MIMAT0027435 Homo sapiens miR-6767-3p
ccacgugcuucucuuuccgcag

SEQ ID NO: 2141 - RNA, 23 nt, Artificial sequence
  >hsa-miR-6767-5p MIMAT0027434 Homo sapiens miR-6767-5p
ucgcagacagggacacauggaga

SEQ ID NO: 2142 - RNA, 24 nt, Artificial sequence
  >hsa-miR-6768-3p MIMAT0027437 Homo sapiens miR-6768-3p
caaaggccacauucuccugugcac

SEQ ID NO: 2143 - RNA, 23 nt, Artificial sequence
  >hsa-miR-6768-5p MIMAT0027436 Homo sapiens miR-6768-5p
cacacaggaaaagcggggcccug

SEQ ID NO: 2144 - RNA, 21 nt, Artificial sequence
  >hsa-miR-6769a-3p MIMAT0027439 Homo sapiens miR-6769a-3p
gagccccucucugcucuccag

SEQ ID NO: 2145 - RNA, 21 nt, Artificial sequence
  >hsa-miR-6769a-5p MIMAT0027438 Homo sapiens miR-6769a-5p
agguggguauggaggagcccu

SEQ ID NO: 2146 - RNA, 21 nt, Artificial sequence
  >hsa-miR-6769b-3p MIMAT0027621 Homo sapiens miR-6769b-3p
cccucucugucccacccauag

SEQ ID NO: 2147 - RNA, 23 nt, Artificial sequence
  >hsa-miR-6769b-5p MIMAT0027620 Homo sapiens miR-6769b-5p
ugguggguggggaggagaagugc

SEQ ID NO: 2148 - RNA, 21 nt, Artificial sequence
  >hsa-miR-6770-3p MIMAT0027441 Homo sapiens miR-6770-3p
cuggcggcugugucuucacag

SEQ ID NO: 2149 - RNA, 24 nt, Artificial sequence
  >hsa-miR-6770-5p MIMAT0027440 Homo sapiens miR-6770-5p
ugagaaggcacagcuugcacguga

SEQ ID NO: 2150 - RNA, 21 nt, Artificial sequence
  >hsa-miR-6771-3p MIMAT0027443 Homo sapiens miR-6771-3p
caaaccccugucuacccgcag

SEQ ID NO: 2151 - RNA, 22 nt, Artificial sequence
  >hsa-miR-6771-5p MIMAT0027442 Homo sapiens miR-6771-5p
cucgggagggcaugggccaggc

SEQ ID NO: 2152 - RNA, 23 nt, Artificial sequence
  >hsa-miR-6772-3p MIMAT0027445 Homo sapiens miR-6772-3p
uugcuccugacucugugcccaca

SEQ ID NO: 2153 - RNA, 22 nt, Artificial sequence
  >hsa-miR-6772-5p MIMAT0027444 Homo sapiens miR-6772-5p
uggguguaggcuggagcugagg

SEQ ID NO: 2154 - RNA, 22 nt, Artificial sequence
  >hsa-miR-6773-3p MIMAT0027447 Homo sapiens miR-6773-3p
acugucacuucucugcccauag

SEQ ID NO: 2155 - RNA, 23 nt, Artificial sequence
  >hsa-miR-6773-5p MIMAT0027446 Homo sapiens miR-6773-5p
uugggcccaggaguaaacaggau

SEQ ID NO: 2156 - RNA, 21 nt, Artificial sequence
  >hsa-miR-6774-3p MIMAT0027449 Homo sapiens miR-6774-3p
ucgugucccucuuguccacag

SEQ ID NO: 2157 - RNA, 25 nt, Artificial sequence
  >hsa-miR-6774-5p MIMAT0027448 Homo sapiens miR-6774-5p
acuugggcaggagggacccuguaug

SEQ ID NO: 2158 - RNA, 21 nt, Artificial sequence
  >hsa-miR-6775-3p MIMAT0027451 Homo sapiens miR-6775-3p
aggcccuguccucugccccag

SEQ ID NO: 2159 - RNA, 25 nt, Artificial sequence
  >hsa-miR-6775-5p MIMAT0027450 Homo sapiens miR-6775-5p
ucggggcaugggggagggaggcugg

SEQ ID NO: 2160 - RNA, 23 nt, Artificial sequence
  >hsa-miR-6776-3p MIMAT0027453 Homo sapiens miR-6776-3p
caaccaccacugucucuccccag

SEQ ID NO: 2161 - RNA, 19 nt, Artificial sequence
  >hsa-miR-6776-5p MIMAT0027452 Homo sapiens miR-6776-5p
ucugggugcaguggggguu

SEQ ID NO: 2162 - RNA, 20 nt, Artificial sequence
  >hsa-miR-6777-3p MIMAT0027455 Homo sapiens miR-6777-3p
uccacucuccuggcccccag

SEQ ID NO: 2163 - RNA, 23 nt, Artificial sequence
  >hsa-miR-6777-5p MIMAT0027454 Homo sapiens miR-6777-5p
acggggagucaggcaguggugga

SEQ ID NO: 2164 - RNA, 21 nt, Artificial sequence
  >hsa-miR-6778-3p MIMAT0027457 Homo sapiens miR-6778-3p
ugccucccugacauuccacag

SEQ ID NO: 2165 - RNA, 22 nt, Artificial sequence
  >hsa-miR-6778-5p MIMAT0027456 Homo sapiens miR-6778-5p
agugggaggacaggaggcaggu

SEQ ID NO: 2166 - RNA, 21 nt, Artificial sequence
  >hsa-miR-6779-3p MIMAT0027459 Homo sapiens miR-6779-3p
aagcccugucuccucccaucu

SEQ ID NO: 2167 - RNA, 21 nt, Artificial sequence
  >hsa-miR-6779-5p MIMAT0027458 Homo sapiens miR-6779-5p
cugggaggggcuggguuuggc

SEQ ID NO: 2168 - RNA, 21 nt, Artificial sequence
  >hsa-miR-6780a-3p MIMAT0027461 Homo sapiens miR-6780a-3p
cuccucuguuuucuuuccuag

SEQ ID NO: 2169 - RNA, 23 nt, Artificial sequence
  >hsa-miR-6780a-5p MIMAT0027460 Homo sapiens miR-6780a-5p
uugggagggaagacagcuggaga

SEQ ID NO: 2170 - RNA, 21 nt, Artificial sequence
  >hsa-miR-6780b-3p MIMAT0027573 Homo sapiens miR-6780b-3p
ucccuugucuccuuucccuag

SEQ ID NO: 2171 - RNA, 23 nt, Artificial sequence
  >hsa-miR-6780b-5p MIMAT0027572 Homo sapiens miR-6780b-5p
uggggaaggcuuggcagggaaga

SEQ ID NO: 2172 - RNA, 22 nt, Artificial sequence
  >hsa-miR-6781-3p MIMAT0027463 Homo sapiens miR-6781-3p
ugccucuuuuccacggccucag

SEQ ID NO: 2173 - RNA, 21 nt, Artificial sequence
  >hsa-miR-6781-5p MIMAT0027462 Homo sapiens miR-6781-5p
cgggccggaggucaagggcgu

SEQ ID NO: 2174 - RNA, 23 nt, Artificial sequence
  >hsa-miR-6782-3p MIMAT0027465 Homo sapiens miR-6782-3p
caccuuuguguccccauccugca

SEQ ID NO: 2175 - RNA, 25 nt, Artificial sequence
  >hsa-miR-6782-5p MIMAT0027464 Homo sapiens miR-6782-5p
uaggggugggggaauucaggggugu

SEQ ID NO: 2176 - RNA, 22 nt, Artificial sequence
  >hsa-miR-6783-3p MIMAT0027467 Homo sapiens miR-6783-3p
uuccugggcuucuccucuguag

SEQ ID NO: 2177 - RNA, 22 nt, Artificial sequence
  >hsa-miR-6783-5p MIMAT0027466 Homo sapiens miR-6783-5p
uaggggaaaaguccugauccgg

SEQ ID NO: 2178 - RNA, 22 nt, Artificial sequence
  >hsa-miR-6784-3p MIMAT0027469 Homo sapiens miR-6784-3p
ucucaccccaacucugccccag

SEQ ID NO: 2179 - RNA, 20 nt, Artificial sequence
  >hsa-miR-6784-5p MIMAT0027468 Homo sapiens miR-6784-5p
gccggggcuuugggugaggg

SEQ ID NO: 2180 - RNA, 21 nt, Artificial sequence
  >hsa-miR-6785-3p MIMAT0027471 Homo sapiens miR-6785-3p
acaucgccccaccuuccccag

SEQ ID NO: 2181 - RNA, 22 nt, Artificial sequence
  >hsa-miR-6785-5p MIMAT0027470 Homo sapiens miR-6785-5p
ugggagggcguggaugauggug

SEQ ID NO: 2182 - RNA, 23 nt, Artificial sequence
  >hsa-miR-6786-3p MIMAT0027473 Homo sapiens miR-6786-3p
ugacgccccuucugauucugccu

SEQ ID NO: 2183 - RNA, 21 nt, Artificial sequence
  >hsa-miR-6786-5p MIMAT0027472 Homo sapiens miR-6786-5p
gcgguggggccggaggggcgu

SEQ ID NO: 2184 - RNA, 22 nt, Artificial sequence
  >hsa-miR-6787-3p MIMAT0027475 Homo sapiens miR-6787-3p
ucucagcugcugcccucuccag

SEQ ID NO: 2185 - RNA, 22 nt, Artificial sequence
  >hsa-miR-6787-5p MIMAT0027474 Homo sapiens miR-6787-5p
uggcggggguagagcuggcugc

SEQ ID NO: 2186 - RNA, 22 nt, Artificial sequence
  >hsa-miR-6788-3p MIMAT0027477 Homo sapiens miR-6788-3p
uucgccacuucccucccugcag

SEQ ID NO: 2187 - RNA, 21 nt, Artificial sequence
  >hsa-miR-6788-5p MIMAT0027476 Homo sapiens miR-6788-5p
cugggagaagaguggugaaga

SEQ ID NO: 2188 - RNA, 21 nt, Artificial sequence
  >hsa-miR-6789-3p MIMAT0027479 Homo sapiens miR-6789-3p
cggcgcccgugucuccuccag

SEQ ID NO: 2189 - RNA, 24 nt, Artificial sequence
  >hsa-miR-6789-5p MIMAT0027478 Homo sapiens miR-6789-5p
guaggggcgucccgggcgcgcggg

SEQ ID NO: 2190 - RNA, 21 nt, Artificial sequence
  >hsa-miR-6790-3p MIMAT0027481 Homo sapiens miR-6790-3p
cgaccucggcgaccccucacu

SEQ ID NO: 2191 - RNA, 23 nt, Artificial sequence
  >hsa-miR-6790-5p MIMAT0027480 Homo sapiens miR-6790-5p
gugaguguggauuuggcgggguu

SEQ ID NO: 2192 - RNA, 21 nt, Artificial sequence
  >hsa-miR-6791-3p MIMAT0027483 Homo sapiens miR-6791-3p
ugccuccuuggucuccggcag

SEQ ID NO: 2193 - RNA, 22 nt, Artificial sequence
  >hsa-miR-6791-5p MIMAT0027482 Homo sapiens miR-6791-5p
ccccuggggcugggcaggcgga

SEQ ID NO: 2194 - RNA, 22 nt, Artificial sequence
  >hsa-miR-6792-3p MIMAT0027485 Homo sapiens miR-6792-3p
cuccuccacagccccugcucau

SEQ ID NO: 2195 - RNA, 21 nt, Artificial sequence
  >hsa-miR-6792-5p MIMAT0027484 Homo sapiens miR-6792-5p
guaagcaggggcucuggguga

SEQ ID NO: 2196 - RNA, 20 nt, Artificial sequence
  >hsa-miR-6793-3p MIMAT0027487 Homo sapiens miR-6793-3p
uccccaaccccugcccgcag

SEQ ID NO: 2197 - RNA, 22 nt, Artificial sequence
  >hsa-miR-6793-5p MIMAT0027486 Homo sapiens miR-6793-5p
uguggguucuggguugggguga

SEQ ID NO: 2198 - RNA, 20 nt, Artificial sequence
  >hsa-miR-6794-3p MIMAT0027489 Homo sapiens miR-6794-3p
cucacucucagucccucccu

SEQ ID NO: 2199 - RNA, 20 nt, Artificial sequence
  >hsa-miR-6794-5p MIMAT0027488 Homo sapiens miR-6794-5p
cagggggacugggggugagc

SEQ ID NO: 2200 - RNA, 21 nt, Artificial sequence
  >hsa-miR-6795-3p MIMAT0027491 Homo sapiens miR-6795-3p
accccucguuucuucccccag

SEQ ID NO: 2201 - RNA, 24 nt, Artificial sequence
  >hsa-miR-6795-5p MIMAT0027490 Homo sapiens miR-6795-5p
uggggggacaggaugagaggcugu

SEQ ID NO: 2202 - RNA, 21 nt, Artificial sequence
  >hsa-miR-6796-3p MIMAT0027493 Homo sapiens miR-6796-3p
gaagcucuccccuccccgcag

SEQ ID NO: 2203 - RNA, 23 nt, Artificial sequence
  >hsa-miR-6796-5p MIMAT0027492 Homo sapiens miR-6796-5p
uugugggguuggagagcuggcug

SEQ ID NO: 2204 - RNA, 22 nt, Artificial sequence
  >hsa-miR-6797-3p MIMAT0027495 Homo sapiens miR-6797-3p
ugcaugacccuucccuccccac

SEQ ID NO: 2205 - RNA, 25 nt, Artificial sequence
  >hsa-miR-6797-5p MIMAT0027494 Homo sapiens miR-6797-5p
aggagggaaggggcugagaacagga

SEQ ID NO: 2206 - RNA, 21 nt, Artificial sequence
  >hsa-miR-6798-3p MIMAT0027497 Homo sapiens miR-6798-3p
cuaccccccaucccccuguag

SEQ ID NO: 2207 - RNA, 23 nt, Artificial sequence
  >hsa-miR-6798-5p MIMAT0027496 Homo sapiens miR-6798-5p
ccagggggaugggcgagcuuggg

SEQ ID NO: 2208 - RNA, 23 nt, Artificial sequence
  >hsa-miR-6799-3p MIMAT0027499 Homo sapiens miR-6799-3p
ugcccugcaugguguccccacag

SEQ ID NO: 2209 - RNA, 20 nt, Artificial sequence
  >hsa-miR-6799-5p MIMAT0027498 Homo sapiens miR-6799-5p
ggggaggugugcagggcugg

SEQ ID NO: 2210 - RNA, 21 nt, Artificial sequence
  >hsa-miR-6800-3p MIMAT0027501 Homo sapiens miR-6800-3p
caccucuccuggcaucgcccc

SEQ ID NO: 2211 - RNA, 21 nt, Artificial sequence
  >hsa-miR-6800-5p MIMAT0027500 Homo sapiens miR-6800-5p
guaggugacagucaggggcgg

SEQ ID NO: 2212 - RNA, 20 nt, Artificial sequence
  >hsa-miR-6801-3p MIMAT0027503 Homo sapiens miR-6801-3p
accccugccacucacuggcc

SEQ ID NO: 2213 - RNA, 23 nt, Artificial sequence
  >hsa-miR-6801-5p MIMAT0027502 Homo sapiens miR-6801-5p
uggucagaggcagcaggaaauga

SEQ ID NO: 2214 - RNA, 22 nt, Artificial sequence
  >hsa-miR-6802-3p MIMAT0027505 Homo sapiens miR-6802-3p
uucaccccucucaccuaagcag

SEQ ID NO: 2215 - RNA, 20 nt, Artificial sequence
  >hsa-miR-6802-5p MIMAT0027504 Homo sapiens miR-6802-5p
cuagguggggggcuugaagc

SEQ ID NO: 2216 - RNA, 22 nt, Artificial sequence
  >hsa-miR-6803-3p MIMAT0027507 Homo sapiens miR-6803-3p
ucccucgccuucucacccucag

SEQ ID NO: 2217 - RNA, 22 nt, Artificial sequence
  >hsa-miR-6803-5p MIMAT0027506 Homo sapiens miR-6803-5p
cuggggguggggggcugggcgu

SEQ ID NO: 2218 - RNA, 22 nt, Artificial sequence
  >hsa-miR-6804-3p MIMAT0027509 Homo sapiens miR-6804-3p
cgcaccugccucucacccacag

SEQ ID NO: 2219 - RNA, 21 nt, Artificial sequence
  >hsa-miR-6804-5p MIMAT0027508 Homo sapiens miR-6804-5p
ugagggugucagcaggugacg

SEQ ID NO: 2220 - RNA, 23 nt, Artificial sequence
  >hsa-miR-6805-3p MIMAT0027511 Homo sapiens miR-6805-3p
uugcucugcucccccgcccccag

SEQ ID NO: 2221 - RNA, 22 nt, Artificial sequence
  >hsa-miR-6805-5p MIMAT0027510 Homo sapiens miR-6805-5p
uagggggcggcuuguggagugu

SEQ ID NO: 2222 - RNA, 22 nt, Artificial sequence
  >hsa-miR-6806-3p MIMAT0027513 Homo sapiens miR-6806-3p
ugaagcucugacauuccugcag

SEQ ID NO: 2223 - RNA, 24 nt, Artificial sequence
  >hsa-miR-6806-5p MIMAT0027512 Homo sapiens miR-6806-5p
uguaggcaugaggcagggcccagg

SEQ ID NO: 2224 - RNA, 23 nt, Artificial sequence
  >hsa-miR-6807-3p MIMAT0027515 Homo sapiens miR-6807-3p
cacugcauuccugcuuggcccag

SEQ ID NO: 2225 - RNA, 22 nt, Artificial sequence
  >hsa-miR-6807-5p MIMAT0027514 Homo sapiens miR-6807-5p
gugagccaguggaauggagagg

SEQ ID NO: 2226 - RNA, 21 nt, Artificial sequence
  >hsa-miR-6808-3p MIMAT0027517 Homo sapiens miR-6808-3p
gugugaccaccguuccugcag

SEQ ID NO: 2227 - RNA, 22 nt, Artificial sequence
  >hsa-miR-6808-5p MIMAT0027516 Homo sapiens miR-6808-5p
caggcagggaggugggaccaug

SEQ ID NO: 2228 - RNA, 21 nt, Artificial sequence
  >hsa-miR-6809-3p MIMAT0027519 Homo sapiens miR-6809-3p
cuucucuucucuccuucccag

SEQ ID NO: 2229 - RNA, 22 nt, Artificial sequence
  >hsa-miR-6809-5p MIMAT0027518 Homo sapiens miR-6809-5p
uggcaaggaaagaagaggauca

SEQ ID NO: 2230 - RNA, 23 nt, Artificial sequence
  >hsa-miR-6810-3p MIMAT0027521 Homo sapiens miR-6810-3p
uccccugcucccuuguuccccag

SEQ ID NO: 2231 - RNA, 23 nt, Artificial sequence
  >hsa-miR-6810-5p MIMAT0027520 Homo sapiens miR-6810-5p
auggggacagggaucagcauggc

SEQ ID NO: 2232 - RNA, 21 nt, Artificial sequence
  >hsa-miR-6811-3p MIMAT0027523 Homo sapiens miR-6811-3p
agccugugcuugucccugcag

SEQ ID NO: 2233 - RNA, 22 nt, Artificial sequence
  >hsa-miR-6811-5p MIMAT0027522 Homo sapiens miR-6811-5p
augcaggccuguguacagcacu

SEQ ID NO: 2234 - RNA, 21 nt, Artificial sequence
  >hsa-miR-6812-3p MIMAT0027525 Homo sapiens miR-6812-3p
ccgcucuuccccugaccccag

SEQ ID NO: 2235 - RNA, 25 nt, Artificial sequence
  >hsa-miR-6812-5p MIMAT0027524 Homo sapiens miR-6812-5p
auggggugagauggggaggagcagc

SEQ ID NO: 2236 - RNA, 21 nt, Artificial sequence
  >hsa-miR-6813-3p MIMAT0027527 Homo sapiens miR-6813-3p
aaccuuggccccucuccccag

SEQ ID NO: 2237 - RNA, 23 nt, Artificial sequence
  >hsa-miR-6813-5p MIMAT0027526 Homo sapiens miR-6813-5p
caggggcugggguuucagguucu

SEQ ID NO: 2238 - RNA, 22 nt, Artificial sequence
  >hsa-miR-6814-3p MIMAT0027529 Homo sapiens miR-6814-3p
acucgcauccuucccuuggcag

SEQ ID NO: 2239 - RNA, 22 nt, Artificial sequence
  >hsa-miR-6814-5p MIMAT0027528 Homo sapiens miR-6814-5p
ucccaagggugagaugcugcca

SEQ ID NO: 2240 - RNA, 21 nt, Artificial sequence
  >hsa-miR-6815-3p MIMAT0027531 Homo sapiens miR-6815-3p
uggcuucucuugcacacccag

SEQ ID NO: 2241 - RNA, 23 nt, Artificial sequence
  >hsa-miR-6815-5p MIMAT0027530 Homo sapiens miR-6815-5p
uagguggcgccggaggagucauu

SEQ ID NO: 2242 - RNA, 18 nt, Artificial sequence
  >hsa-miR-6816-3p MIMAT0027533 Homo sapiens miR-6816-3p
gaaggaccugcaccuucg

SEQ ID NO: 2243 - RNA, 21 nt, Artificial sequence
  >hsa-miR-6816-5p MIMAT0027532 Homo sapiens miR-6816-5p
uggggcggggcaggucccugc

SEQ ID NO: 2244 - RNA, 19 nt, Artificial sequence
  >hsa-miR-6817-3p MIMAT0027535 Homo sapiens miR-6817-3p
ucucucugacuccauggca

SEQ ID NO: 2245 - RNA, 24 nt, Artificial sequence
  >hsa-miR-6817-5p MIMAT0027534 Homo sapiens miR-6817-5p
ucugccauaggaagcuuggagugg

SEQ ID NO: 2246 - RNA, 22 nt, Artificial sequence
  >hsa-miR-6818-3p MIMAT0027537 Homo sapiens miR-6818-3p
uugucucuuguuccucacacag

SEQ ID NO: 2247 - RNA, 22 nt, Artificial sequence
  >hsa-miR-6818-5p MIMAT0027536 Homo sapiens miR-6818-5p
uugugugaguacagagagcauc

SEQ ID NO: 2248 - RNA, 21 nt, Artificial sequence
  >hsa-miR-6819-3p MIMAT0027539 Homo sapiens miR-6819-3p
aagccucuguccccaccccag

SEQ ID NO: 2249 - RNA, 22 nt, Artificial sequence
  >hsa-miR-6819-5p MIMAT0027538 Homo sapiens miR-6819-5p
uugggguggagggccaaggagc

SEQ ID NO: 2250 - RNA, 22 nt, Artificial sequence
  >hsa-miR-6820-3p MIMAT0027541 Homo sapiens miR-6820-3p
ugugacuucuccccugccacag

SEQ ID NO: 2251 - RNA, 19 nt, Artificial sequence
  >hsa-miR-6820-5p MIMAT0027540 Homo sapiens miR-6820-5p
ugcggcagagcugggguca

SEQ ID NO: 2252 - RNA, 21 nt, Artificial sequence
  >hsa-miR-6821-3p MIMAT0027543 Homo sapiens miR-6821-3p
ugaccucuccgcuccgcacag

SEQ ID NO: 2253 - RNA, 23 nt, Artificial sequence
  >hsa-miR-6821-5p MIMAT0027542 Homo sapiens miR-6821-5p
gugcgugguggcucgaggcgggg

SEQ ID NO: 2254 - RNA, 24 nt, Artificial sequence
  >hsa-miR-6822-3p MIMAT0027545 Homo sapiens miR-6822-3p
aggcucuaacuggcuuucccugca

SEQ ID NO: 2255 - RNA, 20 nt, Artificial sequence
  >hsa-miR-6822-5p MIMAT0027544 Homo sapiens miR-6822-5p
cagggaaccaguuggggcuu

SEQ ID NO: 2256 - RNA, 21 nt, Artificial sequence
  >hsa-miR-6823-3p MIMAT0027547 Homo sapiens miR-6823-3p
ugagccucuccuucccuccag

SEQ ID NO: 2257 - RNA, 21 nt, Artificial sequence
  >hsa-miR-6823-5p MIMAT0027546 Homo sapiens miR-6823-5p
ucaggguugguagggguugcu

SEQ ID NO: 2258 - RNA, 21 nt, Artificial sequence
  >hsa-miR-6824-3p MIMAT0027549 Homo sapiens miR-6824-3p
ucucuggucuugccaccccag

SEQ ID NO: 2259 - RNA, 22 nt, Artificial sequence
  >hsa-miR-6824-5p MIMAT0027548 Homo sapiens miR-6824-5p
guaggggagguugggccaggga

SEQ ID NO: 2260 - RNA, 22 nt, Artificial sequence
  >hsa-miR-6825-3p MIMAT0027551 Homo sapiens miR-6825-3p
gcgcugacccgccuucuccgca

SEQ ID NO: 2261 - RNA, 22 nt, Artificial sequence
  >hsa-miR-6825-5p MIMAT0027550 Homo sapiens miR-6825-5p
uggggagguguggagucagcau

SEQ ID NO: 2262 - RNA, 22 nt, Artificial sequence
  >hsa-miR-6826-3p MIMAT0027553 Homo sapiens miR-6826-3p
cuccccucucuuuccuguucag

SEQ ID NO: 2263 - RNA, 23 nt, Artificial sequence
  >hsa-miR-6826-5p MIMAT0027552 Homo sapiens miR-6826-5p
ucaauaggaaagaggugggaccu

SEQ ID NO: 2264 - RNA, 21 nt, Artificial sequence
  >hsa-miR-6827-3p MIMAT0027555 Homo sapiens miR-6827-3p
accgucucuucuguuccccag

SEQ ID NO: 2265 - RNA, 22 nt, Artificial sequence
  >hsa-miR-6827-5p MIMAT0027554 Homo sapiens miR-6827-5p
ugggagccaugagggucugugc

SEQ ID NO: 2266 - RNA, 20 nt, Artificial sequence
  >hsa-miR-6828-3p MIMAT0027557 Homo sapiens miR-6828-3p
aucugcucucuuguucccag

SEQ ID NO: 2267 - RNA, 22 nt, Artificial sequence
  >hsa-miR-6828-5p MIMAT0027556 Homo sapiens miR-6828-5p
aggaagcaagagaacccugugg

SEQ ID NO: 2268 - RNA, 20 nt, Artificial sequence
  >hsa-miR-6829-3p MIMAT0027559 Homo sapiens miR-6829-3p
ugccuccuccguggccucag

SEQ ID NO: 2269 - RNA, 20 nt, Artificial sequence
  >hsa-miR-6829-5p MIMAT0027558 Homo sapiens miR-6829-5p
ugggcugcugagaaggggca

SEQ ID NO: 2270 - RNA, 23 nt, Artificial sequence
  >hsa-miR-6830-3p MIMAT0027561 Homo sapiens miR-6830-3p
ugucuuucuucucucccuugcag

SEQ ID NO: 2271 - RNA, 22 nt, Artificial sequence
  >hsa-miR-6830-5p MIMAT0027560 Homo sapiens miR-6830-5p
ccaaggaaggaggcuggacauc

SEQ ID NO: 2272 - RNA, 21 nt, Artificial sequence
  >hsa-miR-6831-3p MIMAT0027563 Homo sapiens miR-6831-3p
ugacuaacucccacucuacag

SEQ ID NO: 2273 - RNA, 24 nt, Artificial sequence
  >hsa-miR-6831-5p MIMAT0027562 Homo sapiens miR-6831-5p
uagguagagugugaggaggagguc

SEQ ID NO: 2274 - RNA, 20 nt, Artificial sequence
  >hsa-miR-6832-3p MIMAT0027565 Homo sapiens miR-6832-3p
acccuuuuucucuuucccag

SEQ ID NO: 2275 - RNA, 23 nt, Artificial sequence
  >hsa-miR-6832-5p MIMAT0027564 Homo sapiens miR-6832-5p
aguagagaggaaaaguuaggguc

SEQ ID NO: 2276 - RNA, 21 nt, Artificial sequence
  >hsa-miR-6833-3p MIMAT0027567 Homo sapiens miR-6833-3p
uuucucucuccacuuccucag

SEQ ID NO: 2277 - RNA, 22 nt, Artificial sequence
  >hsa-miR-6833-5p MIMAT0027566 Homo sapiens miR-6833-5p
guguggaagaugggaggagaaa

SEQ ID NO: 2278 - RNA, 20 nt, Artificial sequence
  >hsa-miR-6834-3p MIMAT0027569 Homo sapiens miR-6834-3p
uaugucccaucccuccauca

SEQ ID NO: 2279 - RNA, 21 nt, Artificial sequence
  >hsa-miR-6834-5p MIMAT0027568 Homo sapiens miR-6834-5p
gugagggacugggauuugugg

SEQ ID NO: 2280 - RNA, 23 nt, Artificial sequence
  >hsa-miR-6835-3p MIMAT0027571 Homo sapiens miR-6835-3p
aaaagcacuuuucugucucccag

SEQ ID NO: 2281 - RNA, 22 nt, Artificial sequence
  >hsa-miR-6835-5p MIMAT0027570 Homo sapiens miR-6835-5p
aggggguagaaaguggcugaag

SEQ ID NO: 2282 - RNA, 21 nt, Artificial sequence
  >hsa-miR-6836-3p MIMAT0027575 Homo sapiens miR-6836-3p
augccucccccggccccgcag

SEQ ID NO: 2283 - RNA, 22 nt, Artificial sequence
  >hsa-miR-6836-5p MIMAT0027574 Homo sapiens miR-6836-5p
cgcagggcccuggcgcaggcau

SEQ ID NO: 2284 - RNA, 23 nt, Artificial sequence
  >hsa-miR-6837-3p MIMAT0027577 Homo sapiens miR-6837-3p
ccuucacugugacucugcugcag

SEQ ID NO: 2285 - RNA, 21 nt, Artificial sequence
  >hsa-miR-6837-5p MIMAT0027576 Homo sapiens miR-6837-5p
accagggccagcagggaaugu

SEQ ID NO: 2286 - RNA, 20 nt, Artificial sequence
  >hsa-miR-6838-3p MIMAT0027579 Homo sapiens miR-6838-3p
aaguccugcuucuguugcag

SEQ ID NO: 2287 - RNA, 22 nt, Artificial sequence
  >hsa-miR-6838-5p MIMAT0027578 Homo sapiens miR-6838-5p
aagcagcaguggcaagacuccu

SEQ ID NO: 2288 - RNA, 22 nt, Artificial sequence
  >hsa-miR-6839-3p MIMAT0027581 Homo sapiens miR-6839-3p
uuggguuuucucuucaauccag

SEQ ID NO: 2289 - RNA, 22 nt, Artificial sequence
  >hsa-miR-6839-5p MIMAT0027580 Homo sapiens miR-6839-5p
ucuggauugaagagacgaccca

SEQ ID NO: 2290 - RNA, 22 nt, Artificial sequence
  >hsa-miR-6840-3p MIMAT0027583 Homo sapiens miR-6840-3p
gcccaggacuuugugcggggug

SEQ ID NO: 2291 - RNA, 24 nt, Artificial sequence
  >hsa-miR-6840-5p MIMAT0027582 Homo sapiens miR-6840-5p
acccccgggcaaagaccugcagau

SEQ ID NO: 2292 - RNA, 21 nt, Artificial sequence
  >hsa-miR-6841-3p MIMAT0027585 Homo sapiens miR-6841-3p
accuugcaucugcauccccag

SEQ ID NO: 2293 - RNA, 22 nt, Artificial sequence
  >hsa-miR-6841-5p MIMAT0027584 Homo sapiens miR-6841-5p
uaggguacucagagcaaguugu

SEQ ID NO: 2294 - RNA, 22 nt, Artificial sequence
  >hsa-miR-6842-3p MIMAT0027587 Homo sapiens miR-6842-3p
uuggcuggucucugcuccgcag

SEQ ID NO: 2295 - RNA, 22 nt, Artificial sequence
  >hsa-miR-6842-5p MIMAT0027586 Homo sapiens miR-6842-5p
uggggguggucucuagccaagg

SEQ ID NO: 2296 - RNA, 21 nt, Artificial sequence
  >hsa-miR-6843-3p MIMAT0027588 Homo sapiens miR-6843-3p
auggucuccuguucucugcag

SEQ ID NO: 2297 - RNA, 21 nt, Artificial sequence
  >hsa-miR-6844 MIMAT0027589 Homo sapiens miR-6844
uucuuuguuuuuaauucacag

SEQ ID NO: 2298 - RNA, 21 nt, Artificial sequence
  >hsa-miR-6845-3p MIMAT0027591 Homo sapiens miR-6845-3p
ccucuccucccugugccccag

SEQ ID NO: 2299 - RNA, 19 nt, Artificial sequence
  >hsa-miR-6845-5p MIMAT0027590 Homo sapiens miR-6845-5p
cggggccagagcagagagc

SEQ ID NO: 2300 - RNA, 21 nt, Artificial sequence
  >hsa-miR-6846-3p MIMAT0027593 Homo sapiens miR-6846-3p
ugaccccuucugucucccuag

SEQ ID NO: 2301 - RNA, 22 nt, Artificial sequence
  >hsa-miR-6846-5p MIMAT0027592 Homo sapiens miR-6846-5p
ugggggcuggaugggguagagu

SEQ ID NO: 2302 - RNA, 22 nt, Artificial sequence
  >hsa-miR-6847-3p MIMAT0027595 Homo sapiens miR-6847-3p
ggcucaugugucuguccucuuc

SEQ ID NO: 2303 - RNA, 23 nt, Artificial sequence
  >hsa-miR-6847-5p MIMAT0027594 Homo sapiens miR-6847-5p
acagaggacaguggagugugagc

SEQ ID NO: 2304 - RNA, 19 nt, Artificial sequence
  >hsa-miR-6848-3p MIMAT0027597 Homo sapiens miR-6848-3p
guggucucuuggcccccag

SEQ ID NO: 2305 - RNA, 23 nt, Artificial sequence
  >hsa-miR-6848-5p MIMAT0027596 Homo sapiens miR-6848-5p
ugggggcugggaugggccauggu

SEQ ID NO: 2306 - RNA, 22 nt, Artificial sequence
  >hsa-miR-6849-3p MIMAT0027599 Homo sapiens miR-6849-3p
accagccuguguccaccuccag

SEQ ID NO: 2307 - RNA, 23 nt, Artificial sequence
  >hsa-miR-6849-5p MIMAT0027598 Homo sapiens miR-6849-5p
gaguggauaggggagugugugga

SEQ ID NO: 2308 - RNA, 20 nt, Artificial sequence
  >hsa-miR-6850-3p MIMAT0027601 Homo sapiens miR-6850-3p
cccggccggaacgccgcacu

SEQ ID NO: 2309 - RNA, 22 nt, Artificial sequence
  >hsa-miR-6850-5p MIMAT0027600 Homo sapiens miR-6850-5p
gugcggaacgcuggccggggcg

SEQ ID NO: 2310 - RNA, 21 nt, Artificial sequence
  >hsa-miR-6851-3p MIMAT0027603 Homo sapiens miR-6851-3p
uggcccuuuguaccccuccag

SEQ ID NO: 2311 - RNA, 23 nt, Artificial sequence
  >hsa-miR-6851-5p MIMAT0027602 Homo sapiens miR-6851-5p
aggaggugguacuaggggccagc

SEQ ID NO: 2312 - RNA, 17 nt, Artificial sequence
  >hsa-miR-6852-3p MIMAT0027605 Homo sapiens miR-6852-3p
uguccucuguuccucag

SEQ ID NO: 2313 - RNA, 21 nt, Artificial sequence
  >hsa-miR-6852-5p MIMAT0027604 Homo sapiens miR-6852-5p
cccugggguucugaggacaug

SEQ ID NO: 2314 - RNA, 22 nt, Artificial sequence
  >hsa-miR-6853-3p MIMAT0027607 Homo sapiens miR-6853-3p
uguucauuggaacccugcgcag

SEQ ID NO: 2315 - RNA, 24 nt, Artificial sequence
  >hsa-miR-6853-5p MIMAT0027606 Homo sapiens miR-6853-5p
agcgugggauguccaugaagucag

SEQ ID NO: 2316 - RNA, 21 nt, Artificial sequence
  >hsa-miR-6854-3p MIMAT0027609 Homo sapiens miR-6854-3p
ugcguuucuccucuugagcag

SEQ ID NO: 2317 - RNA, 24 nt, Artificial sequence
  >hsa-miR-6854-5p MIMAT0027608 Homo sapiens miR-6854-5p
aagcucagguuugagaacugcuga

SEQ ID NO: 2318 - RNA, 22 nt, Artificial sequence
  >hsa-miR-6855-3p MIMAT0027611 Homo sapiens miR-6855-3p
agacugaccuucaaccccacag

SEQ ID NO: 2319 - RNA, 25 nt, Artificial sequence
  >hsa-miR-6855-5p MIMAT0027610 Homo sapiens miR-6855-5p
uugggguuuggggugcagacauugc

SEQ ID NO: 2320 - RNA, 22 nt, Artificial sequence
  >hsa-miR-6856-3p MIMAT0027613 Homo sapiens miR-6856-3p
uacagcccugugaucuuuccag

SEQ ID NO: 2321 - RNA, 24 nt, Artificial sequence
  >hsa-miR-6856-5p MIMAT0027612 Homo sapiens miR-6856-5p
aagagaggagcaguggugcugugg

SEQ ID NO: 2322 - RNA, 21 nt, Artificial sequence
  >hsa-miR-6857-3p MIMAT0027615 Homo sapiens miR-6857-3p
ugacugagcuucuccccacag

SEQ ID NO: 2323 - RNA, 22 nt, Artificial sequence
  >hsa-miR-6857-5p MIMAT0027614 Homo sapiens miR-6857-5p
uuggggauugggucaggccagu

SEQ ID NO: 2324 - RNA, 22 nt, Artificial sequence
  >hsa-miR-6858-3p MIMAT0027617 Homo sapiens miR-6858-3p
cagccagccccugcucaccccu

SEQ ID NO: 2325 - RNA, 22 nt, Artificial sequence
  >hsa-miR-6858-5p MIMAT0027616 Homo sapiens miR-6858-5p
gugaggaggggcuggcagggac

SEQ ID NO: 2326 - RNA, 23 nt, Artificial sequence
  >hsa-miR-6859-3p MIMAT0027619 Homo sapiens miR-6859-3p
ugacccccaugucgccucuguag

SEQ ID NO: 2327 - RNA, 23 nt, Artificial sequence
  >hsa-miR-6859-5p MIMAT0027618 Homo sapiens miR-6859-5p
gagaggaacaugggcucaggaca

SEQ ID NO: 2328 - RNA, 22 nt, Artificial sequence
  >hsa-miR-6860 MIMAT0027622 Homo sapiens miR-6860
acugggcagggcuguggugagu

SEQ ID NO: 2329 - RNA, 18 nt, Artificial sequence
  >hsa-miR-6861-3p MIMAT0027624 Homo sapiens miR-6861-3p
uggaccucuccuccccag

SEQ ID NO: 2330 - RNA, 22 nt, Artificial sequence
  >hsa-miR-6861-5p MIMAT0027623 Homo sapiens miR-6861-5p
acuggguagguggggcuccagg

SEQ ID NO: 2331 - RNA, 24 nt, Artificial sequence
  >hsa-miR-6862-3p MIMAT0027626 Homo sapiens miR-6862-3p
ccucacccagcucucuggcccucu

SEQ ID NO: 2332 - RNA, 22 nt, Artificial sequence
  >hsa-miR-6862-5p MIMAT0027625 Homo sapiens miR-6862-5p
cgggcaugcugggagagacuuu

SEQ ID NO: 2333 - RNA, 23 nt, Artificial sequence
  >hsa-miR-6863 MIMAT0027627 Homo sapiens miR-6863
uagacguggugaaggauugagug

SEQ ID NO: 2334 - RNA, 21 nt, Artificial sequence
  >hsa-miR-6864-3p MIMAT0027629 Homo sapiens miR-6864-3p
gugagacuucucucccuucag

SEQ ID NO: 2335 - RNA, 24 nt, Artificial sequence
  >hsa-miR-6864-5p MIMAT0027628 Homo sapiens miR-6864-5p
uugaagggacaagucagauaugcc

SEQ ID NO: 2336 - RNA, 21 nt, Artificial sequence
  >hsa-miR-6865-3p MIMAT0027631 Homo sapiens miR-6865-3p
acacccucuuucccuaccgcc

SEQ ID NO: 2337 - RNA, 23 nt, Artificial sequence
  >hsa-miR-6865-5p MIMAT0027630 Homo sapiens miR-6865-5p
uagguggcagaggagggacuuca

SEQ ID NO: 2338 - RNA, 22 nt, Artificial sequence
  >hsa-miR-6866-3p MIMAT0027633 Homo sapiens miR-6866-3p
gaucccuuuaucuguccucuag

SEQ ID NO: 2339 - RNA, 23 nt, Artificial sequence
  >hsa-miR-6866-5p MIMAT0027632 Homo sapiens miR-6866-5p
uuagaggcuggaauagagauucu

SEQ ID NO: 2340 - RNA, 21 nt, Artificial sequence
  >hsa-miR-6867-3p MIMAT0027635 Homo sapiens miR-6867-3p
cucucccucuuuacccacuag

SEQ ID NO: 2341 - RNA, 23 nt, Artificial sequence
  >hsa-miR-6867-5p MIMAT0027634 Homo sapiens miR-6867-5p
uguguguguagaggaagaaggga

SEQ ID NO: 2342 - RNA, 21 nt, Artificial sequence
  >hsa-miR-6868-3p MIMAT0027637 Homo sapiens miR-6868-3p
uuccuucuguugucugugcag

SEQ ID NO: 2343 - RNA, 22 nt, Artificial sequence
  >hsa-miR-6868-5p MIMAT0027636 Homo sapiens miR-6868-5p
acuggcagaacacugaagcagc

SEQ ID NO: 2344 - RNA, 21 nt, Artificial sequence
  >hsa-miR-6869-3p MIMAT0027639 Homo sapiens miR-6869-3p
cgccgcgcgcaucggcucagc

SEQ ID NO: 2345 - RNA, 22 nt, Artificial sequence
  >hsa-miR-6869-5p MIMAT0027638 Homo sapiens miR-6869-5p
gugaguaguggcgcgcggcggc

SEQ ID NO: 2346 - RNA, 22 nt, Artificial sequence
  >hsa-miR-6870-3p MIMAT0027641 Homo sapiens miR-6870-3p
gcucauccccaucuccuuucag

SEQ ID NO: 2347 - RNA, 19 nt, Artificial sequence
  >hsa-miR-6870-5p MIMAT0027640 Homo sapiens miR-6870-5p
ugggggagauggggguuga

SEQ ID NO: 2348 - RNA, 22 nt, Artificial sequence
  >hsa-miR-6871-3p MIMAT0027643 Homo sapiens miR-6871-3p
cagcacccuguggcucccacag

SEQ ID NO: 2349 - RNA, 22 nt, Artificial sequence
  >hsa-miR-6871-5p MIMAT0027642 Homo sapiens miR-6871-5p
caugggaguucggggugguugc

SEQ ID NO: 2350 - RNA, 21 nt, Artificial sequence
  >hsa-miR-6872-3p MIMAT0027645 Homo sapiens miR-6872-3p
cccaugccuccugccgcgguc

SEQ ID NO: 2351 - RNA, 20 nt, Artificial sequence
  >hsa-miR-6872-5p MIMAT0027644 Homo sapiens miR-6872-5p
ucucgcaucaggaggcaagg

SEQ ID NO: 2352 - RNA, 23 nt, Artificial sequence
  >hsa-miR-6873-3p MIMAT0027647 Homo sapiens miR-6873-3p
uucucucugucuuucucucucag

SEQ ID NO: 2353 - RNA, 22 nt, Artificial sequence
  >hsa-miR-6873-5p MIMAT0027646 Homo sapiens miR-6873-5p
cagagggaauacagagggcaau

SEQ ID NO: 2354 - RNA, 23 nt, Artificial sequence
  >hsa-miR-6874-3p MIMAT0027649 Homo sapiens miR-6874-3p
caguucugcuguucugacucuag

SEQ ID NO: 2355 - RNA, 23 nt, Artificial sequence
  >hsa-miR-6874-5p MIMAT0027648 Homo sapiens miR-6874-5p
auggagcuggaaccagaucaggc

SEQ ID NO: 2356 - RNA, 22 nt, Artificial sequence
  >hsa-miR-6875-3p MIMAT0027651 Homo sapiens miR-6875-3p
auucuuccugcccuggcuccau

SEQ ID NO: 2357 - RNA, 21 nt, Artificial sequence
  >hsa-miR-6875-5p MIMAT0027650 Homo sapiens miR-6875-5p
ugagggacccaggacaggaga

SEQ ID NO: 2358 - RNA, 24 nt, Artificial sequence
  >hsa-miR-6876-3p MIMAT0027653 Homo sapiens miR-6876-3p
agcugucuguguuuuccuucucag

SEQ ID NO: 2359 - RNA, 22 nt, Artificial sequence
  >hsa-miR-6876-5p MIMAT0027652 Homo sapiens miR-6876-5p
caggaaggagacaggcaguuca

SEQ ID NO: 2360 - RNA, 21 nt, Artificial sequence
  >hsa-miR-6877-3p MIMAT0027655 Homo sapiens miR-6877-3p
cagccucugcccuuggccucc

SEQ ID NO: 2361 - RNA, 22 nt, Artificial sequence
  >hsa-miR-6877-5p MIMAT0027654 Homo sapiens miR-6877-5p
agggccgaaggguggaagcugc

SEQ ID NO: 2362 - RNA, 21 nt, Artificial sequence
  >hsa-miR-6878-3p MIMAT0027657 Homo sapiens miR-6878-3p
cuggccucuucuuucuccuag

SEQ ID NO: 2363 - RNA, 23 nt, Artificial sequence
  >hsa-miR-6878-5p MIMAT0027656 Homo sapiens miR-6878-5p
agggagaaagcuagaagcugaag

SEQ ID NO: 2364 - RNA, 21 nt, Artificial sequence
  >hsa-miR-6879-3p MIMAT0027659 Homo sapiens miR-6879-3p
ugucacccgcuccuugcccag

SEQ ID NO: 2365 - RNA, 22 nt, Artificial sequence
  >hsa-miR-6879-5p MIMAT0027658 Homo sapiens miR-6879-5p
cagggcagggaaggugggagag

SEQ ID NO: 2366 - RNA, 21 nt, Artificial sequence
  >hsa-miR-6880-3p MIMAT0027661 Homo sapiens miR-6880-3p
ccgccuucucuccucccccag

SEQ ID NO: 2367 - RNA, 22 nt, Artificial sequence
  >hsa-miR-6880-5p MIMAT0027660 Homo sapiens miR-6880-5p
ugguggaggaagagggcagcuc

SEQ ID NO: 2368 - RNA, 22 nt, Artificial sequence
  >hsa-miR-6881-3p MIMAT0027663 Homo sapiens miR-6881-3p
auccucuuucguccuucccacu

SEQ ID NO: 2369 - RNA, 22 nt, Artificial sequence
  >hsa-miR-6881-5p MIMAT0027662 Homo sapiens miR-6881-5p
ugggguaaggauaggaggguca

SEQ ID NO: 2370 - RNA, 24 nt, Artificial sequence
  >hsa-miR-6882-3p MIMAT0027665 Homo sapiens miR-6882-3p
ugcugccucuccucuugccugcag

SEQ ID NO: 2371 - RNA, 22 nt, Artificial sequence
  >hsa-miR-6882-5p MIMAT0027664 Homo sapiens miR-6882-5p
uacaagucaggagcugaagcag

SEQ ID NO: 2372 - RNA, 22 nt, Artificial sequence
  >hsa-miR-6883-3p MIMAT0027667 Homo sapiens miR-6883-3p
uucccuaucucacucuccucag

SEQ ID NO: 2373 - RNA, 22 nt, Artificial sequence
  >hsa-miR-6883-5p MIMAT0027666 Homo sapiens miR-6883-5p
agggagggugugguauggaugu

SEQ ID NO: 2374 - RNA, 23 nt, Artificial sequence
  >hsa-miR-6884-3p MIMAT0027669 Homo sapiens miR-6884-3p
cccaucaccuuuccgucuccccu

SEQ ID NO: 2375 - RNA, 22 nt, Artificial sequence
  >hsa-miR-6884-5p MIMAT0027668 Homo sapiens miR-6884-5p
agaggcugagaaggugauguug

SEQ ID NO: 2376 - RNA, 21 nt, Artificial sequence
  >hsa-miR-6885-3p MIMAT0027671 Homo sapiens miR-6885-3p
cuuugcuuccugcuccccuag

SEQ ID NO: 2377 - RNA, 25 nt, Artificial sequence
  >hsa-miR-6885-5p MIMAT0027670 Homo sapiens miR-6885-5p
aggggggcacugcgcaagcaaagcc

SEQ ID NO: 2378 - RNA, 21 nt, Artificial sequence
  >hsa-miR-6886-3p MIMAT0027673 Homo sapiens miR-6886-3p
ugcccuucucuccuccugccu

SEQ ID NO: 2379 - RNA, 21 nt, Artificial sequence
  >hsa-miR-6886-5p MIMAT0027672 Homo sapiens miR-6886-5p
cccgcaggugagaugagggcu

SEQ ID NO: 2380 - RNA, 21 nt, Artificial sequence
  >hsa-miR-6887-3p MIMAT0027675 Homo sapiens miR-6887-3p
uccccuccacuuuccuccuag

SEQ ID NO: 2381 - RNA, 23 nt, Artificial sequence
  >hsa-miR-6887-5p MIMAT0027674 Homo sapiens miR-6887-5p
uggggggacagauggagaggaca

SEQ ID NO: 2382 - RNA, 21 nt, Artificial sequence
  >hsa-miR-6888-3p MIMAT0027677 Homo sapiens miR-6888-3p
aucugucucgauuguuuccag

SEQ ID NO: 2383 - RNA, 20 nt, Artificial sequence
  >hsa-miR-6888-5p MIMAT0027676 Homo sapiens miR-6888-5p
aaggagaugcucaggcagau

SEQ ID NO: 2384 - RNA, 20 nt, Artificial sequence
  >hsa-miR-6889-3p MIMAT0027679 Homo sapiens miR-6889-3p
ucugugccccuacuucccag

SEQ ID NO: 2385 - RNA, 23 nt, Artificial sequence
  >hsa-miR-6889-5p MIMAT0027678 Homo sapiens miR-6889-5p
ucggggagucugggguccggaau

SEQ ID NO: 2386 - RNA, 20 nt, Artificial sequence
  >hsa-miR-6890-3p MIMAT0027681 Homo sapiens miR-6890-3p
ccacugccuaugccccacag

SEQ ID NO: 2387 - RNA, 21 nt, Artificial sequence
  >hsa-miR-6890-5p MIMAT0027680 Homo sapiens miR-6890-5p
caugggguagggcagaguagg

SEQ ID NO: 2388 - RNA, 21 nt, Artificial sequence
  >hsa-miR-6891-3p MIMAT0027683 Homo sapiens miR-6891-3p
cccucaucuuccccuccuuuc

SEQ ID NO: 2389 - RNA, 19 nt, Artificial sequence
  >hsa-miR-6891-5p MIMAT0027682 Homo sapiens miR-6891-5p
uaaggagggggaugagggg

SEQ ID NO: 2390 - RNA, 21 nt, Artificial sequence
  >hsa-miR-6892-3p MIMAT0027685 Homo sapiens miR-6892-3p
ucccucucccaccccuugcag

SEQ ID NO: 2391 - RNA, 21 nt, Artificial sequence
  >hsa-miR-6892-5p MIMAT0027684 Homo sapiens miR-6892-5p
guaagggaccggagaguagga

SEQ ID NO: 2392 - RNA, 22 nt, Artificial sequence
  >hsa-miR-6893-3p MIMAT0027687 Homo sapiens miR-6893-3p
cccugcugccuucaccugccag

SEQ ID NO: 2393 - RNA, 21 nt, Artificial sequence
  >hsa-miR-6893-5p MIMAT0027686 Homo sapiens miR-6893-5p
caggcagguguaggguggagc

SEQ ID NO: 2394 - RNA, 21 nt, Artificial sequence
  >hsa-miR-6894-3p MIMAT0027689 Homo sapiens miR-6894-3p
uugccugcccucuuccuccag

SEQ ID NO: 2395 - RNA, 24 nt, Artificial sequence
  >hsa-miR-6894-5p MIMAT0027688 Homo sapiens miR-6894-5p
aggaggauggagagcugggccaga

SEQ ID NO: 2396 - RNA, 22 nt, Artificial sequence
  >hsa-miR-6895-3p MIMAT0027691 Homo sapiens miR-6895-3p
ugucucucgcccuuggccuuag

SEQ ID NO: 2397 - RNA, 21 nt, Artificial sequence
  >hsa-miR-6895-5p MIMAT0027690 Homo sapiens miR-6895-5p
cagggccaggcacagaguaag

SEQ ID NO: 2398 - RNA, 22 nt, Artificial sequence
  >hsa-miR-7-1-3p MIMAT0004553 Homo sapiens miR-7-1-3p
caacaaaucacagucugccaua

SEQ ID NO: 2399 - RNA, 22 nt, Artificial sequence
  >hsa-miR-7-2-3p MIMAT0004554 Homo sapiens miR-7-2-3p
caacaaaucccagucuaccuaa

SEQ ID NO: 2400 - RNA, 23 nt, Artificial sequence
  >hsa-miR-7-5p MIMAT0000252 Homo sapiens miR-7-5p
uggaagacuagugauuuuguugu

SEQ ID NO: 2401 - RNA, 22 nt, Artificial sequence
  >hsa-miR-708-3p MIMAT0004927 Homo sapiens miR-708-3p
caacuagacugugagcuucuag

SEQ ID NO: 2402 - RNA, 23 nt, Artificial sequence
  >hsa-miR-708-5p MIMAT0004926 Homo sapiens miR-708-5p
aaggagcuuacaaucuagcuggg

SEQ ID NO: 2403 - RNA, 23 nt, Artificial sequence
  >hsa-miR-7106-3p MIMAT0028110 Homo sapiens miR-7106-3p
agcucccugaaucccugucccag

SEQ ID NO: 2404 - RNA, 20 nt, Artificial sequence
  >hsa-miR-7106-5p MIMAT0028109 Homo sapiens miR-7106-5p
ugggaggaggggaucuuggg

SEQ ID NO: 2405 - RNA, 27 nt, Artificial sequence
  >hsa-miR-7107-3p MIMAT0028112 Homo sapiens miR-7107-3p
uggucuguucauucucucuuuuuggcc

SEQ ID NO: 2406 - RNA, 22 nt, Artificial sequence
  >hsa-miR-7107-5p MIMAT0028111 Homo sapiens miR-7107-5p
ucggccuggggaggaggaaggg

SEQ ID NO: 2407 - RNA, 20 nt, Artificial sequence
  >hsa-miR-7108-3p MIMAT0028114 Homo sapiens miR-7108-3p
acccgcccgucuccccacag

SEQ ID NO: 2408 - RNA, 21 nt, Artificial sequence
  >hsa-miR-7108-5p MIMAT0028113 Homo sapiens miR-7108-5p
guguggccggcaggcgggugg

SEQ ID NO: 2409 - RNA, 22 nt, Artificial sequence
  >hsa-miR-7109-3p MIMAT0028116 Homo sapiens miR-7109-3p
caagccucuccugcccuuccag

SEQ ID NO: 2410 - RNA, 21 nt, Artificial sequence
  >hsa-miR-7109-5p MIMAT0028115 Homo sapiens miR-7109-5p
cuggggggaggagacccugcu

SEQ ID NO: 2411 - RNA, 22 nt, Artificial sequence
  >hsa-miR-711 MIMAT0012734 Homo sapiens miR-711
gggacccagggagagacguaag

SEQ ID NO: 2412 - RNA, 22 nt, Artificial sequence
  >hsa-miR-7110-3p MIMAT0028118 Homo sapiens miR-7110-3p
ucucucucccacuucccugcag

SEQ ID NO: 2413 - RNA, 21 nt, Artificial sequence
  >hsa-miR-7110-5p MIMAT0028117 Homo sapiens miR-7110-5p
uggggguguggggagagagag

SEQ ID NO: 2414 - RNA, 22 nt, Artificial sequence
  >hsa-miR-7111-3p MIMAT0028120 Homo sapiens miR-7111-3p
auccucucuucccuccucccag

SEQ ID NO: 2415 - RNA, 22 nt, Artificial sequence
  >hsa-miR-7111-5p MIMAT0028119 Homo sapiens miR-7111-5p
ugggggaggaaggacaggccau

SEQ ID NO: 2416 - RNA, 23 nt, Artificial sequence
  >hsa-miR-7112-3p MIMAT0028122 Homo sapiens miR-7112-3p
ugcaucacagccuuuggcccuag

SEQ ID NO: 2417 - RNA, 22 nt, Artificial sequence
  >hsa-miR-7112-5p MIMAT0028121 Homo sapiens miR-7112-5p
acgggcagggcagugcacccug

SEQ ID NO: 2418 - RNA, 23 nt, Artificial sequence
  >hsa-miR-7113-3p MIMAT0028124 Homo sapiens miR-7113-3p
ccucccugcccgccucucugcag

SEQ ID NO: 2419 - RNA, 21 nt, Artificial sequence
  >hsa-miR-7113-5p MIMAT0028123 Homo sapiens miR-7113-5p
uccagggagacagugugugag

SEQ ID NO: 2420 - RNA, 21 nt, Artificial sequence
  >hsa-miR-7114-3p MIMAT0028126 Homo sapiens miR-7114-3p
ugacccaccccucuccaccag

SEQ ID NO: 2421 - RNA, 21 nt, Artificial sequence
  >hsa-miR-7114-5p MIMAT0028125 Homo sapiens miR-7114-5p
ucuguggaguggggugccugu

SEQ ID NO: 2422 - RNA, 18 nt, Artificial sequence
  >hsa-miR-7150 MIMAT0028211 Homo sapiens miR-7150
cuggcagggggagaggua

SEQ ID NO: 2423 - RNA, 21 nt, Artificial sequence
  >hsa-miR-7151-3p MIMAT0028213 Homo sapiens miR-7151-3p
cuacaggcuggaaugggcuca

SEQ ID NO: 2424 - RNA, 23 nt, Artificial sequence
  >hsa-miR-7151-5p MIMAT0028212 Homo sapiens miR-7151-5p
gauccaucucugccuguauuggc

SEQ ID NO: 2425 - RNA, 20 nt, Artificial sequence
  >hsa-miR-7152-3p MIMAT0028215 Homo sapiens miR-7152-3p
ucugguccuggacaggaggc

SEQ ID NO: 2426 - RNA, 22 nt, Artificial sequence
  >hsa-miR-7152-5p MIMAT0028214 Homo sapiens miR-7152-5p
uuuccuguccuccaaccagacc

SEQ ID NO: 2427 - RNA, 18 nt, Artificial sequence
  >hsa-miR-7153-3p MIMAT0028217 Homo sapiens miR-7153-3p
caccauggacgguuuacc

SEQ ID NO: 2428 - RNA, 23 nt, Artificial sequence
  >hsa-miR-7153-5p MIMAT0028216 Homo sapiens miR-7153-5p
ugagaacugacaaaugugguagg

SEQ ID NO: 2429 - RNA, 20 nt, Artificial sequence
  >hsa-miR-7154-3p MIMAT0028219 Homo sapiens miR-7154-3p
aggaggacaaguugugggau

SEQ ID NO: 2430 - RNA, 23 nt, Artificial sequence
  >hsa-miR-7154-5p MIMAT0028218 Homo sapiens miR-7154-5p
uucaugaacugggucuagcuugg

SEQ ID NO: 2431 - RNA, 19 nt, Artificial sequence
  >hsa-miR-7155-3p MIMAT0028221 Homo sapiens miR-7155-3p
uggcccaagaccucagacc

SEQ ID NO: 2432 - RNA, 19 nt, Artificial sequence
  >hsa-miR-7155-5p MIMAT0028220 Homo sapiens miR-7155-5p
ucuggggucuugggccauc

SEQ ID NO: 2433 - RNA, 23 nt, Artificial sequence
  >hsa-miR-7156-3p MIMAT0028223 Homo sapiens miR-7156-3p
cugcagccacuuggggaacuggu

SEQ ID NO: 2434 - RNA, 23 nt, Artificial sequence
  >hsa-miR-7156-5p MIMAT0028222 Homo sapiens miR-7156-5p
uuguucucaaacuggcugucaga

SEQ ID NO: 2435 - RNA, 22 nt, Artificial sequence
  >hsa-miR-7157-3p MIMAT0028225 Homo sapiens miR-7157-3p
ucugugcuacuggaugaagagu

SEQ ID NO: 2436 - RNA, 23 nt, Artificial sequence
  >hsa-miR-7157-5p MIMAT0028224 Homo sapiens miR-7157-5p
ucagcauucauuggcaccagaga

SEQ ID NO: 2437 - RNA, 21 nt, Artificial sequence
  >hsa-miR-7158-3p MIMAT0028227 Homo sapiens miR-7158-3p
cugaacuagagauugggccca

SEQ ID NO: 2438 - RNA, 24 nt, Artificial sequence
  >hsa-miR-7158-5p MIMAT0028226 Homo sapiens miR-7158-5p
ggcucaaucucugguccugcagcc

SEQ ID NO: 2439 - RNA, 19 nt, Artificial sequence
  >hsa-miR-7159-3p MIMAT0028229 Homo sapiens miR-7159-3p
uuucuauguuaguuggaag

SEQ ID NO: 2440 - RNA, 21 nt, Artificial sequence
  >hsa-miR-7159-5p MIMAT0028228 Homo sapiens miR-7159-5p
uucaacaaggguguaggaugg

SEQ ID NO: 2441 - RNA, 21 nt, Artificial sequence
  >hsa-miR-7160-3p MIMAT0028231 Homo sapiens miR-7160-3p
cagggcccuggcuuuagcaga

SEQ ID NO: 2442 - RNA, 21 nt, Artificial sequence
  >hsa-miR-7160-5p MIMAT0028230 Homo sapiens miR-7160-5p
ugcugagguccgggcugugcc

SEQ ID NO: 2443 - RNA, 28 nt, Artificial sequence
  >hsa-miR-7161-3p MIMAT0028233 Homo sapiens miR-7161-3p
uagaucuuugacucuggcagucuccagg

SEQ ID NO: 2444 - RNA, 23 nt, Artificial sequence
  >hsa-miR-7161-5p MIMAT0028232 Homo sapiens miR-7161-5p
uaaagacuguagaggcaacuggu

SEQ ID NO: 2445 - RNA, 19 nt, Artificial sequence
  >hsa-miR-7162-3p MIMAT0028235 Homo sapiens miR-7162-3p
ucugagguggaacagcagc

SEQ ID NO: 2446 - RNA, 18 nt, Artificial sequence
  >hsa-miR-7162-5p MIMAT0028234 Homo sapiens miR-7162-5p
ugcuuccuuucucagcug

SEQ ID NO: 2447 - RNA, 21 nt, Artificial sequence
  >hsa-miR-718 MIMAT0012735 Homo sapiens miR-718
cuuccgccccgccgggcgucg

SEQ ID NO: 2448 - RNA, 22 nt, Artificial sequence
  >hsa-miR-744-3p MIMAT0004946 Homo sapiens miR-744-3p
cuguugccacuaaccucaaccu

SEQ ID NO: 2449 - RNA, 22 nt, Artificial sequence
  >hsa-miR-744-5p MIMAT0004945 Homo sapiens miR-744-5p
ugcggggcuagggcuaacagca

SEQ ID NO: 2450 - RNA, 18 nt, Artificial sequence
  >hsa-miR-7515 MIMAT0029310 Homo sapiens miR-7515
agaagggaagauggugac

SEQ ID NO: 2451 - RNA, 22 nt, Artificial sequence
  >hsa-miR-758-3p MIMAT0003879 Homo sapiens miR-758-3p
uuugugaccugguccacuaacc

SEQ ID NO: 2452 - RNA, 22 nt, Artificial sequence
  >hsa-miR-758-5p MIMAT0022929 Homo sapiens miR-758-5p
gaugguugaccagagagcacac

SEQ ID NO: 2453 - RNA, 22 nt, Artificial sequence
  >hsa-miR-759 MIMAT0010497 Homo sapiens miR-759
gcagagugcaaacaauuuugac

SEQ ID NO: 2454 - RNA, 20 nt, Artificial sequence
  >hsa-miR-760 MIMAT0004957 Homo sapiens miR-760
cggcucugggucugugggga

SEQ ID NO: 2455 - RNA, 22 nt, Artificial sequence
  >hsa-miR-761 MIMAT0010364 Homo sapiens miR-761
gcagcagggugaaacugacaca

SEQ ID NO: 2456 - RNA, 22 nt, Artificial sequence
  >hsa-miR-762 MIMAT0010313 Homo sapiens miR-762
ggggcuggggccggggccgagc

SEQ ID NO: 2457 - RNA, 22 nt, Artificial sequence
  >hsa-miR-764 MIMAT0010367 Homo sapiens miR-764
gcaggugcucacuuguccuccu

SEQ ID NO: 2458 - RNA, 19 nt, Artificial sequence
  >hsa-miR-7641 MIMAT0029782 Homo sapiens miR-7641
uugaucucggaagcuaagc

SEQ ID NO: 2459 - RNA, 21 nt, Artificial sequence
  >hsa-miR-765 MIMAT0003945 Homo sapiens miR-765
uggaggagaaggaaggugaug

SEQ ID NO: 2460 - RNA, 22 nt, Artificial sequence
  >hsa-miR-766-3p MIMAT0003888 Homo sapiens miR-766-3p
acuccagccccacagccucagc

SEQ ID NO: 2461 - RNA, 22 nt, Artificial sequence
  >hsa-miR-766-5p MIMAT0022714 Homo sapiens miR-766-5p
aggaggaauuggugcuggucuu

SEQ ID NO: 2462 - RNA, 23 nt, Artificial sequence
  >hsa-miR-767-3p MIMAT0003883 Homo sapiens miR-767-3p
ucugcucauaccccaugguuucu

SEQ ID NO: 2463 - RNA, 23 nt, Artificial sequence
  >hsa-miR-767-5p MIMAT0003882 Homo sapiens miR-767-5p
ugcaccaugguugucugagcaug

SEQ ID NO: 2464 - RNA, 23 nt, Artificial sequence
  >hsa-miR-769-3p MIMAT0003887 Homo sapiens miR-769-3p
cugggaucuccggggucuugguu

SEQ ID NO: 2465 - RNA, 22 nt, Artificial sequence
  >hsa-miR-769-5p MIMAT0003886 Homo sapiens miR-769-5p
ugagaccucuggguucugagcu

SEQ ID NO: 2466 - RNA, 23 nt, Artificial sequence
  >hsa-miR-770-5p MIMAT0003948 Homo sapiens miR-770-5p
uccaguaccacgugucagggcca

SEQ ID NO: 2467 - RNA, 22 nt, Artificial sequence
  >hsa-miR-7702 MIMAT0030017 Homo sapiens miR-7702
cuuagacugccagacucccuga

SEQ ID NO: 2468 - RNA, 23 nt, Artificial sequence
  >hsa-miR-7703 MIMAT0030018 Homo sapiens miR-7703
uugcacucuggccuucucccagg

SEQ ID NO: 2469 - RNA, 19 nt, Artificial sequence
  >hsa-miR-7704 MIMAT0030019 Homo sapiens miR-7704
cggggucggcggcgacgug

SEQ ID NO: 2470 - RNA, 23 nt, Artificial sequence
  >hsa-miR-7705 MIMAT0030020 Homo sapiens miR-7705
aauagcucagaaugucaguucug

SEQ ID NO: 2471 - RNA, 24 nt, Artificial sequence
  >hsa-miR-7706 MIMAT0030021 Homo sapiens miR-7706
ugaagcgccugugcucugccgaga

SEQ ID NO: 2472 - RNA, 22 nt, Artificial sequence
  >hsa-miR-7843-3p MIMAT0030412 Homo sapiens miR-7843-3p
augaagccuucucugccuuacg

SEQ ID NO: 2473 - RNA, 22 nt, Artificial sequence
  >hsa-miR-7843-5p MIMAT0030411 Homo sapiens miR-7843-5p
gagggcagagccagcuuccuga

SEQ ID NO: 2474 - RNA, 22 nt, Artificial sequence
  >hsa-miR-7844-5p MIMAT0030419 Homo sapiens miR-7844-5p
aaaacuaggacuguguggugua

SEQ ID NO: 2475 - RNA, 21 nt, Artificial sequence
  >hsa-miR-7845-5p MIMAT0030420 Homo sapiens miR-7845-5p
aagggacagggagggucgugg

SEQ ID NO: 2476 - RNA, 21 nt, Artificial sequence
  >hsa-miR-7846-3p MIMAT0030421 Homo sapiens miR-7846-3p
cagcggagccuggagagaagg

SEQ ID NO: 2477 - RNA, 21 nt, Artificial sequence
  >hsa-miR-7847-3p MIMAT0030422 Homo sapiens miR-7847-3p
cguggaggacgaggaggaggc

SEQ ID NO: 2478 - RNA, 23 nt, Artificial sequence
  >hsa-miR-7848-3p MIMAT0030423 Homo sapiens miR-7848-3p
cuacccucggucugcuuaccaca

SEQ ID NO: 2479 - RNA, 22 nt, Artificial sequence
  >hsa-miR-7849-3p MIMAT0030424 Homo sapiens miR-7849-3p
gacaauuguugaucuugggccu

SEQ ID NO: 2480 - RNA, 21 nt, Artificial sequence
  >hsa-miR-7850-5p MIMAT0030425 Homo sapiens miR-7850-5p
guuuggacauaguguggcugg

SEQ ID NO: 2481 - RNA, 22 nt, Artificial sequence
  >hsa-miR-7851-3p MIMAT0030426 Homo sapiens miR-7851-3p
uaccugggagacugagguugga

SEQ ID NO: 2482 - RNA, 22 nt, Artificial sequence
  >hsa-miR-7852-3p MIMAT0030427 Homo sapiens miR-7852-3p
uauguaguagucaaaggcauuu

SEQ ID NO: 2483 - RNA, 21 nt, Artificial sequence
  >hsa-miR-7853-5p MIMAT0030428 Homo sapiens miR-7853-5p
ucaaaugcagauccugacuuc

SEQ ID NO: 2484 - RNA, 21 nt, Artificial sequence
  >hsa-miR-7854-3p MIMAT0030429 Homo sapiens miR-7854-3p
ugaggugaccgcagaugggaa

SEQ ID NO: 2485 - RNA, 22 nt, Artificial sequence
  >hsa-miR-7855-5p MIMAT0030430 Homo sapiens miR-7855-5p
uuggugaggaccccaagcucgg

SEQ ID NO: 2486 - RNA, 21 nt, Artificial sequence
  >hsa-miR-7856-5p MIMAT0030431 Homo sapiens miR-7856-5p
uuuuaaggacacugagggauc

SEQ ID NO: 2487 - RNA, 20 nt, Artificial sequence
  >hsa-miR-7973 MIMAT0031176 Homo sapiens miR-7973
ugugacccuagaauaauuac

SEQ ID NO: 2488 - RNA, 24 nt, Artificial sequence
  >hsa-miR-7974 MIMAT0031177 Homo sapiens miR-7974
aggcugugaugcucuccugagccc

SEQ ID NO: 2489 - RNA, 18 nt, Artificial sequence
  >hsa-miR-7975 MIMAT0031178 Homo sapiens miR-7975
auccuagucacggcacca

SEQ ID NO: 2490 - RNA, 19 nt, Artificial sequence
  >hsa-miR-7976 MIMAT0031179 Homo sapiens miR-7976
ugcccugagacuuuugcuc

SEQ ID NO: 2491 - RNA, 18 nt, Artificial sequence
  >hsa-miR-7977 MIMAT0031180 Homo sapiens miR-7977
uucccagccaacgcacca

SEQ ID NO: 2492 - RNA, 21 nt, Artificial sequence
  >hsa-miR-7978 MIMAT0031181 Homo sapiens miR-7978
ucugguguauagcguugcuca

SEQ ID NO: 2493 - RNA, 23 nt, Artificial sequence
  >hsa-miR-802 MIMAT0004185 Homo sapiens miR-802
caguaacaaagauucauccuugu

SEQ ID NO: 2494 - RNA, 22 nt, Artificial sequence
  >hsa-miR-8052 MIMAT0030979 Homo sapiens miR-8052
cgggacuguagagggcaugagc

SEQ ID NO: 2495 - RNA, 24 nt, Artificial sequence
  >hsa-miR-8053 MIMAT0030980 Homo sapiens miR-8053
uggcgauuuuggaacucaauggca

SEQ ID NO: 2496 - RNA, 21 nt, Artificial sequence
  >hsa-miR-8054 MIMAT0030981 Homo sapiens miR-8054
gaaaguacagaucggaugggu

SEQ ID NO: 2497 - RNA, 23 nt, Artificial sequence
  >hsa-miR-8055 MIMAT0030982 Homo sapiens miR-8055
cuuugagcacaugagcagacgga

SEQ ID NO: 2498 - RNA, 20 nt, Artificial sequence
  >hsa-miR-8056 MIMAT0030983 Homo sapiens miR-8056
cguggauugucuggaugcau

SEQ ID NO: 2499 - RNA, 21 nt, Artificial sequence
  >hsa-miR-8057 MIMAT0030984 Homo sapiens miR-8057
guggcucuguaguaagaugga

SEQ ID NO: 2500 - RNA, 22 nt, Artificial sequence
  >hsa-miR-8058 MIMAT0030985 Homo sapiens miR-8058
cuggacuuugaucuugccauaa

SEQ ID NO: 2501 - RNA, 22 nt, Artificial sequence
  >hsa-miR-8059 MIMAT0030986 Homo sapiens miR-8059
ggggaacuguagaugaaaaggc

SEQ ID NO: 2502 - RNA, 24 nt, Artificial sequence
  >hsa-miR-8060 MIMAT0030987 Homo sapiens miR-8060
ccaugaagcaguggguaggaggac

SEQ ID NO: 2503 - RNA, 21 nt, Artificial sequence
  >hsa-miR-8061 MIMAT0030988 Homo sapiens miR-8061
cuuagauuagaggauauuguu

SEQ ID NO: 2504 - RNA, 21 nt, Artificial sequence
  >hsa-miR-8062 MIMAT0030989 Homo sapiens miR-8062
cagugauuugaggauuauugc

SEQ ID NO: 2505 - RNA, 22 nt, Artificial sequence
  >hsa-miR-8063 MIMAT0030990 Homo sapiens miR-8063
ucaaaaucaggagucggggcuu

SEQ ID NO: 2506 - RNA, 20 nt, Artificial sequence
  >hsa-miR-8064 MIMAT0030991 Homo sapiens miR-8064
agcacacugagcgagcggac

SEQ ID NO: 2507 - RNA, 24 nt, Artificial sequence
  >hsa-miR-8065 MIMAT0030992 Homo sapiens miR-8065
uguaggaacaguugaauuuuggcu

SEQ ID NO: 2508 - RNA, 21 nt, Artificial sequence
  >hsa-miR-8066 MIMAT0030993 Homo sapiens miR-8066
caaugugaucuuuuggaugua

SEQ ID NO: 2509 - RNA, 22 nt, Artificial sequence
  >hsa-miR-8067 MIMAT0030994 Homo sapiens miR-8067
ccuagaaacuguaaacuuaguc

SEQ ID NO: 2510 - RNA, 22 nt, Artificial sequence
  >hsa-miR-8068 MIMAT0030995 Homo sapiens miR-8068
uguuuguuguaaggaucguugu

SEQ ID NO: 2511 - RNA, 23 nt, Artificial sequence
  >hsa-miR-8069 MIMAT0030996 Homo sapiens miR-8069
ggaugguugggggcggucggcgu

SEQ ID NO: 2512 - RNA, 22 nt, Artificial sequence
  >hsa-miR-8070 MIMAT0030997 Homo sapiens miR-8070
augugauugacggcugacucca

SEQ ID NO: 2513 - RNA, 20 nt, Artificial sequence
  >hsa-miR-8071 MIMAT0030998 Homo sapiens miR-8071
cgguggacuggagugggugg

SEQ ID NO: 2514 - RNA, 20 nt, Artificial sequence
  >hsa-miR-8072 MIMAT0030999 Homo sapiens miR-8072
ggcggcggggagguaggcag

SEQ ID NO: 2515 - RNA, 22 nt, Artificial sequence
  >hsa-miR-8073 MIMAT0031000 Homo sapiens miR-8073
accuggcagcagggagcgucgu

SEQ ID NO: 2516 - RNA, 24 nt, Artificial sequence
  >hsa-miR-8074 MIMAT0031001 Homo sapiens miR-8074
cuauggcgagacuggcauguacuc

SEQ ID NO: 2517 - RNA, 24 nt, Artificial sequence
  >hsa-miR-8075 MIMAT0031002 Homo sapiens miR-8075
ugcugauggcagaugucgggucug

SEQ ID NO: 2518 - RNA, 24 nt, Artificial sequence
  >hsa-miR-8076 MIMAT0031003 Homo sapiens miR-8076
uauauggacuuuucugauacaaug

SEQ ID NO: 2519 - RNA, 22 nt, Artificial sequence
  >hsa-miR-8077 MIMAT0031004 Homo sapiens miR-8077
ggcugagugggguucugacucc

SEQ ID NO: 2520 - RNA, 23 nt, Artificial sequence
  >hsa-miR-8078 MIMAT0031005 Homo sapiens miR-8078
ggucuaggcccggugagagacuc

SEQ ID NO: 2521 - RNA, 20 nt, Artificial sequence
  >hsa-miR-8079 MIMAT0031006 Homo sapiens miR-8079
cagugaucgucucugcuggc

SEQ ID NO: 2522 - RNA, 23 nt, Artificial sequence
  >hsa-miR-8080 MIMAT0031007 Homo sapiens miR-8080
gaaggacacuggugucaacggcu

SEQ ID NO: 2523 - RNA, 23 nt, Artificial sequence
  >hsa-miR-8081 MIMAT0031008 Homo sapiens miR-8081
cuugagucgugccuuucugaaug

SEQ ID NO: 2524 - RNA, 22 nt, Artificial sequence
  >hsa-miR-8082 MIMAT0031009 Homo sapiens miR-8082
ugauggagcugggaauacucug

SEQ ID NO: 2525 - RNA, 21 nt, Artificial sequence
  >hsa-miR-8083 MIMAT0031010 Homo sapiens miR-8083
caggacuugacggcugcaacu

SEQ ID NO: 2526 - RNA, 23 nt, Artificial sequence
  >hsa-miR-8084 MIMAT0031011 Homo sapiens miR-8084
gaauacuaaguaaaaaaucagua

SEQ ID NO: 2527 - RNA, 21 nt, Artificial sequence
  >hsa-miR-8085 MIMAT0031012 Homo sapiens miR-8085
ugggagagaggacugugaggc

SEQ ID NO: 2528 - RNA, 22 nt, Artificial sequence
  >hsa-miR-8086 MIMAT0031013 Homo sapiens miR-8086
ugcuagucuggacugauauggu

SEQ ID NO: 2529 - RNA, 23 nt, Artificial sequence
  >hsa-miR-8087 MIMAT0031014 Homo sapiens miR-8087
gaagacuucuuggauuacagggg

SEQ ID NO: 2530 - RNA, 21 nt, Artificial sequence
  >hsa-miR-8088 MIMAT0031015 Homo sapiens miR-8088
ccucgguacuggaaaggggua

SEQ ID NO: 2531 - RNA, 24 nt, Artificial sequence
  >hsa-miR-8089 MIMAT0031016 Homo sapiens miR-8089
ccuggggacaggggauuggggcag

SEQ ID NO: 2532 - RNA, 21 nt, Artificial sequence
  >hsa-miR-8485 MIMAT0033692 Homo sapiens miR-8485
cacacacacacacacacguau

SEQ ID NO: 2533 - RNA, 22 nt, Artificial sequence
  >hsa-miR-873-3p MIMAT0022717 Homo sapiens miR-873-3p
ggagacugaugaguucccggga

SEQ ID NO: 2534 - RNA, 21 nt, Artificial sequence
  >hsa-miR-873-5p MIMAT0004953 Homo sapiens miR-873-5p
gcaggaacuugugagucuccu

SEQ ID NO: 2535 - RNA, 22 nt, Artificial sequence
  >hsa-miR-874-3p MIMAT0004911 Homo sapiens miR-874-3p
cugcccuggcccgagggaccga

SEQ ID NO: 2536 - RNA, 23 nt, Artificial sequence
  >hsa-miR-874-5p MIMAT0026718 Homo sapiens miR-874-5p
cggccccacgcaccaggguaaga

SEQ ID NO: 2537 - RNA, 21 nt, Artificial sequence
  >hsa-miR-875-3p MIMAT0004923 Homo sapiens miR-875-3p
ccuggaaacacugagguugug

SEQ ID NO: 2538 - RNA, 22 nt, Artificial sequence
  >hsa-miR-875-5p MIMAT0004922 Homo sapiens miR-875-5p
uauaccucaguuuuaucaggug

SEQ ID NO: 2539 - RNA, 22 nt, Artificial sequence
  >hsa-miR-876-3p MIMAT0004925 Homo sapiens miR-876-3p
uggugguuuacaaaguaauuca

SEQ ID NO: 2540 - RNA, 22 nt, Artificial sequence
  >hsa-miR-876-5p MIMAT0004924 Homo sapiens miR-876-5p
uggauuucuuugugaaucacca

SEQ ID NO: 2541 - RNA, 21 nt, Artificial sequence
  >hsa-miR-877-3p MIMAT0004950 Homo sapiens miR-877-3p
uccucuucucccuccucccag

SEQ ID NO: 2542 - RNA, 20 nt, Artificial sequence
  >hsa-miR-877-5p MIMAT0004949 Homo sapiens miR-877-5p
guagaggagauggcgcaggg

SEQ ID NO: 2543 - RNA, 22 nt, Artificial sequence
  >hsa-miR-885-3p MIMAT0004948 Homo sapiens miR-885-3p
aggcagcgggguguaguggaua

SEQ ID NO: 2544 - RNA, 22 nt, Artificial sequence
  >hsa-miR-885-5p MIMAT0004947 Homo sapiens miR-885-5p
uccauuacacuacccugccucu

SEQ ID NO: 2545 - RNA, 22 nt, Artificial sequence
  >hsa-miR-887-3p MIMAT0004951 Homo sapiens miR-887-3p
gugaacgggcgccaucccgagg

SEQ ID NO: 2546 - RNA, 21 nt, Artificial sequence
  >hsa-miR-887-5p MIMAT0026720 Homo sapiens miR-887-5p
cuugggagcccuguuagacuc

SEQ ID NO: 2547 - RNA, 22 nt, Artificial sequence
  >hsa-miR-888-3p MIMAT0004917 Homo sapiens miR-888-3p
gacugacaccucuuugggugaa

SEQ ID NO: 2548 - RNA, 21 nt, Artificial sequence
  >hsa-miR-888-5p MIMAT0004916 Homo sapiens miR-888-5p
uacucaaaaagcugucaguca

SEQ ID NO: 2549 - RNA, 21 nt, Artificial sequence
  >hsa-miR-889-3p MIMAT0004921 Homo sapiens miR-889-3p
uuaauaucggacaaccauugu

SEQ ID NO: 2550 - RNA, 22 nt, Artificial sequence
  >hsa-miR-889-5p MIMAT0026719 Homo sapiens miR-889-5p
aauggcuguccguaguaugguc

SEQ ID NO: 2551 - RNA, 21 nt, Artificial sequence
  >hsa-miR-890 MIMAT0004912 Homo sapiens miR-890
uacuuggaaaggcaucaguug

SEQ ID NO: 2552 - RNA, 22 nt, Artificial sequence
  >hsa-miR-891a-3p MIMAT0026717 Homo sapiens miR-891a-3p
aguggcacauguuuguugugag

SEQ ID NO: 2553 - RNA, 22 nt, Artificial sequence
  >hsa-miR-891a-5p MIMAT0004902 Homo sapiens miR-891a-5p
ugcaacgaaccugagccacuga

SEQ ID NO: 2554 - RNA, 22 nt, Artificial sequence
  >hsa-miR-891b MIMAT0004913 Homo sapiens miR-891b
ugcaacuuaccugagucauuga

SEQ ID NO: 2555 - RNA, 21 nt, Artificial sequence
  >hsa-miR-892a MIMAT0004907 Homo sapiens miR-892a
cacuguguccuuucugcguag

SEQ ID NO: 2556 - RNA, 22 nt, Artificial sequence
  >hsa-miR-892b MIMAT0004918 Homo sapiens miR-892b
cacuggcuccuuucuggguaga

SEQ ID NO: 2557 - RNA, 22 nt, Artificial sequence
  >hsa-miR-892c-3p MIMAT0025858 Homo sapiens miR-892c-3p
cacuguuuccuuucugagugga

SEQ ID NO: 2558 - RNA, 21 nt, Artificial sequence
  >hsa-miR-892c-5p MIMAT0025857 Homo sapiens miR-892c-5p
uauucagaaaggugccaguca

SEQ ID NO: 2559 - RNA, 22 nt, Artificial sequence
  >hsa-miR-9-3p MIMAT0000442 Homo sapiens miR-9-3p
auaaagcuagauaaccgaaagu

SEQ ID NO: 2560 - RNA, 23 nt, Artificial sequence
  >hsa-miR-9-5p MIMAT0000441 Homo sapiens miR-9-5p
ucuuugguuaucuagcuguauga

SEQ ID NO: 2561 - RNA, 20 nt, Artificial sequence
  >hsa-miR-920 MIMAT0004970 Homo sapiens miR-920
ggggagcuguggaagcagua

SEQ ID NO: 2562 - RNA, 25 nt, Artificial sequence
  >hsa-miR-921 MIMAT0004971 Homo sapiens miR-921
cuagugagggacagaaccaggauuc

SEQ ID NO: 2563 - RNA, 23 nt, Artificial sequence
  >hsa-miR-922 MIMAT0004972 Homo sapiens miR-922
gcagcagagaauaggacuacguc

SEQ ID NO: 2564 - RNA, 20 nt, Artificial sequence
  >hsa-miR-924 MIMAT0004974 Homo sapiens miR-924
agagucuugugaugucuugc

SEQ ID NO: 2565 - RNA, 23 nt, Artificial sequence
  >hsa-miR-92a-1-5p MIMAT0004507 Homo sapiens miR-92a-1-5p
agguugggaucgguugcaaugcu

SEQ ID NO: 2566 - RNA, 22 nt, Artificial sequence
  >hsa-miR-92a-2-5p MIMAT0004508 Homo sapiens miR-92a-2-5p
ggguggggauuuguugcauuac

SEQ ID NO: 2567 - RNA, 22 nt, Artificial sequence
  >hsa-miR-92a-3p MIMAT0000092 Homo sapiens miR-92a-3p
uauugcacuugucccggccugu

SEQ ID NO: 2568 - RNA, 22 nt, Artificial sequence
  >hsa-miR-92b-3p MIMAT0003218 Homo sapiens miR-92b-3p
uauugcacucgucccggccucc

SEQ ID NO: 2569 - RNA, 22 nt, Artificial sequence
  >hsa-miR-92b-5p MIMAT0004792 Homo sapiens miR-92b-5p
agggacgggacgcggugcagug

SEQ ID NO: 2570 - RNA, 22 nt, Artificial sequence
  >hsa-miR-93-3p MIMAT0004509 Homo sapiens miR-93-3p
acugcugagcuagcacuucccg

SEQ ID NO: 2571 - RNA, 23 nt, Artificial sequence
  >hsa-miR-93-5p MIMAT0000093 Homo sapiens miR-93-5p
caaagugcuguucgugcagguag

SEQ ID NO: 2572 - RNA, 22 nt, Artificial sequence
  >hsa-miR-933 MIMAT0004976 Homo sapiens miR-933
ugugcgcagggagaccucuccc

SEQ ID NO: 2573 - RNA, 22 nt, Artificial sequence
  >hsa-miR-934 MIMAT0004977 Homo sapiens miR-934
ugucuacuacuggagacacugg

SEQ ID NO: 2574 - RNA, 23 nt, Artificial sequence
  >hsa-miR-935 MIMAT0004978 Homo sapiens miR-935
ccaguuaccgcuuccgcuaccgc

SEQ ID NO: 2575 - RNA, 22 nt, Artificial sequence
  >hsa-miR-936 MIMAT0004979 Homo sapiens miR-936
acaguagagggaggaaucgcag

SEQ ID NO: 2576 - RNA, 22 nt, Artificial sequence
  >hsa-miR-937-3p MIMAT0004980 Homo sapiens miR-937-3p
auccgcgcucugacucucugcc

SEQ ID NO: 2577 - RNA, 20 nt, Artificial sequence
  >hsa-miR-937-5p MIMAT0022938 Homo sapiens miR-937-5p
gugagucaggguggggcugg

SEQ ID NO: 2578 - RNA, 22 nt, Artificial sequence
  >hsa-miR-938 MIMAT0004981 Homo sapiens miR-938
ugcccuuaaaggugaacccagu

SEQ ID NO: 2579 - RNA, 21 nt, Artificial sequence
  >hsa-miR-939-3p MIMAT0022939 Homo sapiens miR-939-3p
cccugggccucugcuccccag

SEQ ID NO: 2580 - RNA, 24 nt, Artificial sequence
  >hsa-miR-939-5p MIMAT0004982 Homo sapiens miR-939-5p
uggggagcugaggcucugggggug

SEQ ID NO: 2581 - RNA, 21 nt, Artificial sequence
  >hsa-miR-940 MIMAT0004983 Homo sapiens miR-940
aaggcagggcccccgcucccc

SEQ ID NO: 2582 - RNA, 23 nt, Artificial sequence
  >hsa-miR-941 MIMAT0004984 Homo sapiens miR-941
cacccggcugugugcacaugugc

SEQ ID NO: 2583 - RNA, 22 nt, Artificial sequence
  >hsa-miR-942-3p MIMAT0026734 Homo sapiens miR-942-3p
cacauggccgaaacagagaagu

SEQ ID NO: 2584 - RNA, 22 nt, Artificial sequence
  >hsa-miR-942-5p MIMAT0004985 Homo sapiens miR-942-5p
ucuucucuguuuuggccaugug

SEQ ID NO: 2585 - RNA, 21 nt, Artificial sequence
  >hsa-miR-943 MIMAT0004986 Homo sapiens miR-943
cugacuguugccguccuccag

SEQ ID NO: 2586 - RNA, 22 nt, Artificial sequence
  >hsa-miR-944 MIMAT0004987 Homo sapiens miR-944
aaauuauuguacaucggaugag

SEQ ID NO: 2587 - RNA, 22 nt, Artificial sequence
  >hsa-miR-95-3p MIMAT0000094 Homo sapiens miR-95-3p
uucaacggguauuuauugagca

SEQ ID NO: 2588 - RNA, 21 nt, Artificial sequence
  >hsa-miR-95-5p MIMAT0026473 Homo sapiens miR-95-5p
ucaauaaaugucuguugaauu

SEQ ID NO: 2589 - RNA, 19 nt, Artificial sequence
  >hsa-miR-9500 MIMAT0035542 Homo sapiens miR-9500
aagggaagauggugaccac

SEQ ID NO: 2590 - RNA, 22 nt, Artificial sequence
  >hsa-miR-96-3p MIMAT0004510 Homo sapiens miR-96-3p
aaucaugugcagugccaauaug

SEQ ID NO: 2591 - RNA, 23 nt, Artificial sequence
  >hsa-miR-96-5p MIMAT0000095 Homo sapiens miR-96-5p
uuuggcacuagcacauuuuugcu

SEQ ID NO: 2592 - RNA, 22 nt, Artificial sequence
  >hsa-miR-98-3p MIMAT0022842 Homo sapiens miR-98-3p
cuauacaacuuacuacuuuccc

SEQ ID NO: 2593 - RNA, 22 nt, Artificial sequence
  >hsa-miR-98-5p MIMAT0000096 Homo sapiens miR-98-5p
ugagguaguaaguuguauuguu

SEQ ID NO: 2594 - RNA, 22 nt, Artificial sequence
  >hsa-miR-99a-3p MIMAT0004511 Homo sapiens miR-99a-3p
caagcucgcuucuaugggucug

SEQ ID NO: 2595 - RNA, 22 nt, Artificial sequence
  >hsa-miR-99a-5p MIMAT0000097 Homo sapiens miR-99a-5p
aacccguagauccgaucuugug

SEQ ID NO: 2596 - RNA, 22 nt, Artificial sequence
  >hsa-miR-99b-3p MIMAT0004678 Homo sapiens miR-99b-3p
caagcucgugucuguggguccg

SEQ ID NO: 2597 - RNA, 22 nt, Artificial sequence
  >hsa-miR-99b-5p MIMAT0000689 Homo sapiens miR-99b-5p
cacccguagaaccgaccuugcg

SEQ ID NO: 2598 - RNA, 23 nt, Artificial sequence
  Synthetic sequence
ccgguuuucgauuagguuugacu

SEQ ID NO: 2599 - RNA, 23 nt, Artificial sequence
  Drosophila melanogaster bantam/ bantam5p
ccgguuuucgauuugguuugacu

SEQ ID NO: 2600 - RNA, 18 nt, Artificial sequence
  Synthetic sequence
guaggcugccuaggaacg

SEQ ID NO: 2601 - RNA, 101 nt, Artificial sequence
  Synthetic sequence
gggagcguacuucuggguuuacuguugcaauggucaugugaagggagcacgggcguuguguucgccagagaagcuacuugcaguuaaaaauaacaggacac

SEQ ID NO: 2602 - RNA, 23 nt, Artificial sequence
  Synthetic sequence
cggcuuuucgauuugguuugacu

SEQ ID NO: 2603 - RNA, 23 nt, Artificial sequence
  Synthetic sequence
cggcuuaucgauuugguuugacu

SEQ ID NO: 2604 - RNA, 23 nt, Artificial sequence
  Synthetic sequence
gcgguuuucgauuugguuugacu

SEQ ID NO: 2605 - RNA, 23 nt, Artificial sequence
  Synthetic sequence
cggguuuucgauuugguuugacu

SEQ ID NO: 2606 - RNA, 23 nt, Artificial sequence
  Synthetic sequence
cccguuuucgauuugguuugacu

SEQ ID NO: 2607 - RNA, 23 nt, Artificial sequence
  Synthetic sequence
ccgcuuuucgauuugguuugacu

SEQ ID NO: 2608 - RNA, 23 nt, Artificial sequence
  Synthetic sequence
ccggauuucgauuugguuugacu

SEQ ID NO: 2609 - RNA, 24 nt, Artificial sequence
  Drosophila melanogaster miR-263a
aauggcacuggaagaauucacggg

SEQ ID NO: 2610 - RNA, 24 nt, Artificial sequence
  Synthetic sequence
aaacggacuggaagaauucacggg

SEQ ID NO: 2611 - RNA, 21 nt, Artificial sequence
  Drosophila melanogaster miR-1000
auauuguccugucacagcagu

SEQ ID NO: 2612 - RNA, 21 nt, Artificial sequence
  Synthetic sequence
auuaucuccugucacagcagu

SEQ ID NO: 2613 - RNA, 23 nt, Artificial sequence
  Synthetic sequence
ccgguuuucgcuuugguuugacu

SEQ ID NO: 2614 - RNA, 46 nt, Artificial sequence
  Drosophila melanogaster snoR442
cgcaagccuguugggugugauucugcuugucauaguuacucugauc

SEQ ID NO: 2615 - RNA, 24 nt, Artificial sequence
  snoR442 target 5' region
cgcaagccuguugggugugauucu

SEQ ID NO: 2616 - RNA, 22 nt, Artificial sequence
  Synthetic sequence
gcuugucauaguuacucugauc

SEQ ID NO: 2617 - RNA, 23 nt, Artificial sequence
  bantam-3p
ugagaucauuuugaaagcugauu

SEQ ID NO: 2618 - RNA, 128 nt, Artificial sequence
  PNDN-bantam-3p
gggacaccugagugucccaaucagcuuucuuguugaguagagugugagcuccguaacuaguuacaucacgggagauguaacugaaugaaauggugaaggacggguccaaaugaucucaugcuucggca

SEQ ID NO: 2619 - RNA, 129 nt, Artificial sequence
  PNDN-dme-miR-263a
gggacaccugaguguccccccgugaauucuuccuuguugaguagagugugagcuccguaacuaguuacaucacgggagauguaacugaaugaaauggugaaggacggguccaugccauuugcuucggca

SEQ ID NO: 2620 - RNA, 135 nt, Artificial sequence
  PNDN-dme-miR-263a_6nt (PNDN-dme-miR-263a with 6nt in SL3)
gggacaccugaguguccccccgugaauucuuccuuguugaguagagugugagcuccguaacuaguuacaucacgggagauguaacugaaugaaauggugaaggacggguccaugccauuggcugcuucggcagcc

SEQ ID NO: 2621 - RNA, 141 nt, Artificial sequence
  PNDN263a_9nt (PNDN263a with 9nt in SL3)
gggacaccugaguguccccccgugaauucuuccuuguugaguagagugugagcuccguaacuaguuacaucacgggagauguaacugaaugaaauggugaaggacggguccaugccauuguaggcugcuucggcagccuac

SEQ ID NO: 2622 - RNA, 147 nt, Artificial sequence
  PNDN263a_12nt (PNDN263a with 12nt in SL3)
gggacaccugaguguccccccgugaauucuuccuuguugaguagagugugagcuccguaacuaguuacaucacgggagauguaacugaaugaaauggugaaggacggguccaugccauugacguaggcugcuucggcagccuacguc

SEQ ID NO: 2623 - RNA, 128 nt, Artificial sequence
  PNDN-dme-bantam5p
gggacaccugagugucccagucaaaccauuguugaguagagugugagcuccguaacuaguuacaucacgggagauguaacugaaugaaauggugaaggacggguccaucgaaaaccggugcuucggca

SEQ ID NO: 2624 - RNA, 134 nt, Artificial sequence
  PNDN-bantam-5p_6nt (PNDN-bantam-5p with 6nt in SL3)
gggacaccugagugucccagucaaaccauuguugaguagagugugagcuccguaacuaguuacaucacgggagauguaacugaaugaaauggugaaggacggguccaucgaaaaccggggcugcuucggcagcc

SEQ ID NO: 2625 - RNA, 140 nt, Artificial sequence
  PNDNbantam5p_9nt (PNDNbantam5p with 9nt in SL3)
gggacaccugagugucccagucaaaccauuguugaguagagugugagcuccguaacuaguuacaucacgggagauguaacugaaugaaauggugaaggacggguccaucgaaaaccggguaggcugcuucggcagccuac

SEQ ID NO: 2626 - RNA, 146 nt, Artificial sequence
  PNDNbantam5p_12nt (PNDNbantam5p with 12nt SL3)
gggacaccugagugucccagucaaaccauuguugaguagagugugagcuccguaacuaguuacaucacgggagauguaacugaaugaaauggugaaggacggguccaucgaaaaccgggacguaggcugcuucggcagccuacguc

SEQ ID NO: 2627 - RNA, 140 nt, Artificial sequence
  PNDNbantam5p_10nt (PNDNbantam5p with 10nt in SL4)
gggacacuugcugacaagugucccagucaaaccauuguugaguagagugugagcuccguaacuaguuacaucacgggagauguaacugaaugaaauggugaaggacggguccaucgaaaaccggggcugcuucggcagcc

SEQ ID NO: 2628 - RNA, 146 nt, Artificial sequence
  PNDNbantam5p_13nt (PNDNbantam5p with 13nt in SL4)
gggacacuugcagcugacugcaagugucccagucaaaccauuguugaguagagugugagcuccguaacuaguuacaucacgggagauguaacugaaugaaauggugaaggacggguccaucgaaaaccggggcugcuucggcagcc

SEQ ID NO: 2629 - RNA, 126 nt, Artificial sequence
  PNDN-dme-miR-1000
gggacaccugagugucccacugcuguguuguugaguagagugugagcuccguaacuaguuacaucacgggagauguaacugaaugaaauggugaaggacggguccaaggacaauauugcuucggca

SEQ ID NO: 2630 - RNA, 132 nt, Artificial sequence
  PNDN-dme-miR-1000_6nt (PNDN-dme-miR-1000 with 6nt in SL3)
gggacaccugagugucccacugcuguguuguugaguagagugugagcuccguaacuaguuacaucacgggagauguaacugaaugaaauggugaaggacggguccaaggacaauauggcugcuucggcagcc

SEQ ID NO: 2631 - RNA, 138 nt, Artificial sequence
  PNDN1000_9nt (PNDN1000 with 9nt in SL3)
gggacaccugagugucccacugcuguguuguugaguagagugugagcuccguaacuaguuacaucacgggagauguaacugaaugaaauggugaaggacggguccaaggacaauauguaggcugcuucggcagccuac

SEQ ID NO: 2632 - RNA, 144 nt, Artificial sequence
  PNDN1000_12nt (PNDN1000 with 12nt in SL3)
gggacaccugagugucccacugcuguguuguugaguagagugugagcuccguaacuaguuacaucacgggagauguaacugaaugaaauggugaaggacggguccaaggacaauaugacguaggcugcuucggcagccuacguc

SEQ ID NO: 2633 - RNA, 24 nt, Artificial sequence
  hsa_miR-21-5p
guagcuuaucagacugauguugac

SEQ ID NO: 2634 - RNA, 129 nt, Artificial sequence
  PNDN-hsa-miR21-5p
gggacaccugagugucccgucaacaucuuguugaguagagugugagcuccguaacuaguuacaucacgggagauguaacugaaugaaauggugaaggacggguccaucugauaagcuacugcuucggca

SEQ ID NO: 2635 - RNA, 21 nt, Artificial sequence
  hsa_miR-375
uuuguucguucggcucgcgug

SEQ ID NO: 2636 - RNA, 126 nt, Artificial sequence
  PNDN-hsa_miR-375
gggacaccugaguguccccacgcgagccguuguugaguagagugugagcuccguaacuaguuacaucacgggagauguaacugaaugaaauggugaaggacggguccacgaacaaaugcuucggca

SEQ ID NO: 2637 - RNA, 22 nt, Artificial sequence
  hsa_miR-223-3p
gucaguuugucaaauaccccaa

SEQ ID NO: 2638 - RNA, 127 nt, Artificial sequence
  PNDN-hsa_miR-223-3p
gggacaccugagugucccuugggguauuuguuguugaguagagugugagcuccguaacuaguuacaucacgggagauguaacugaaugaaauggugaaggacggguccaaaacugacugcuucggca

SEQ ID NO: 2639 - RNA, 23 nt, Artificial sequence
  hsa_miR-223-5p
cguguauuugacaagcugaguug

SEQ ID NO: 2640 - RNA, 128 nt, Artificial sequence
  PNDN-hsa_miR-223-5p
gggacaccugaguguccccaacucagcuugucuuguugaguagagugugagcuccguaacuaguuacaucacgggagauguaacugaaugaaauggugaaggacggguccaauacacgugcuucggca

SEQ ID NO: 2641 - RNA, 127 nt, Artificial sequence
  PNDN-hsa_miR-122
gggacaccugaguguccccaaacaccuuguugaguagagugugagcuccguaacuaguuacaucacgggagauguaacugaaugaaauggugaaggacggguccaugucacacuccaugcuucggca

SEQ ID NO: 2642 - RNA, 24 nt, Artificial sequence
  hsa_let7f
ugagguaguagauuguauaguugu

SEQ ID NO: 2643 - RNA, 129 nt, Artificial sequence
  PNDN-hsa_let7f
gggacaccugagugucccacaacuauacauuguugaguagagugugagcuccguaacuaguuacaucacgggagauguaacugaaugaaauggugaaggacggguccacuacuaccucaugcuucggca

SEQ ID NO: 2644 - RNA, 22 nt, Artificial sequence
  dme-miR-124
uaaggcacgcggugaaugccaa

SEQ ID NO: 2645 - RNA, 155 nt, Artificial sequence
  PNDN-dme-miR-124
gggacaccugagugucccuuggcauucuuguugaguagagugugagcuccguaacuaguuacaucacgggagauguaacugaaugaaauggugaaggacggguccacgcgugccuuaggcugcuucggcagccuaaggcacgcggugaaugccaa

SEQ ID NO: 2646 - RNA, 22 nt, Artificial sequence
  dme-miR-14
ucagucuuuuucucucuccuau

SEQ ID NO: 2647 - RNA, 155 nt, Artificial sequence
  PNDN-dme-miR-14
gggacaccugagugucccauaggagagaguuguugaguagagugugagcuccguaacuaguuacaucacgggagauguaacugaaugaaauggugaaggacggguccaaaagacugaggcugcuucggcagccucagucuuuuucucucuccuau

SEQ ID NO: 2648 - RNA, 22 nt, Artificial sequence
  dme-miR-184
uggacggagaacugauaagggc

SEQ ID NO: 2649 - RNA, 133 nt, Artificial sequence
  PNDN-dme-miR-184
gggacaccugagugucccgcccuuaucuuguugaguagagugugagcuccguaacuaguuacaucacgggagauguaacugaaugaaauggugaaggacggguccauucuccguccaggcugcuucggcagcc

SEQ ID NO: 2650 - RNA, 22 nt, Artificial sequence
  dme-miR-252
cuaaguacuagugccgcaggag

SEQ ID NO: 2651 - RNA, 133 nt, Artificial sequence
  PNDN-dme-miR-252
gggacaccugaguguccccuccugcggcuuguugaguagagugugagcuccguaacuaguuacaucacgggagauguaacugaaugaaauggugaaggacggguccauaguacuuagggcugcuucggcagcc

SEQ ID NO: 2652 - RNA, 128 nt, Artificial sequence
  PNDN_snoR442_5
gggacaccugagugucccgaaucacacccuuguugaguagagugugagcuccguaacuaguuacaucacgggagauguaacugaaugaaauggugaaggacggguccacaggcuugcgugcuucggca

SEQ ID NO: 2653 - RNA, 23 nt, Artificial sequence
  snoR442 target 3' region
ugcuugucauaguuacucugauc

SEQ ID NO: 2654 - RNA, 128 nt, Artificial sequence
  PNDN_snoR442_3
gggacaccugagugucccgaucagaguauuguugaguagagugugagcuccguaacuaguuacaucacgggagauguaacugaaugaaauggugaaggacggguccauaugacaagcaugcuucggca

SEQ ID NO: 2655 - RNA, 23 nt, Artificial sequence
  Synthetic sequence
ugagaucauuuggaaagcugauu

SEQ ID NO: 2656 - RNA, 23 nt, Artificial sequence
  Synthetic sequence
ugagaucauuucgaaagcugauu

SEQ ID NO: 2657 - RNA, 23 nt, Artificial sequence
  Synthetic sequence
ugagaucauuuagaaagcugauu

SEQ ID NO: 2658 - RNA, 79 nt, Artificial Sequence
  Synthetic sequence
  misc_feature (79)..(79): (n) is any naturally occurring nucleotide; wherein (n) is a sequence complementary to the target RNA; wherein this (n) is attached to SEQ ID NO 2659
uuguugaguagagugugagcuccguaacuaguuacaucacgggagauguaacugaaugaaauggugaaggacggguccn

SEQ ID NO: 2659 - RNA, 16 nt, Artificial Sequence
  Synthetic sequence
ggcugcuucggcagcc

SEQ ID NO: 2660 - RNA, 14 nt, Artificial Sequence
  Pandan miR-263a sensor without an extension in the stem
uuugcuucggcaaa

SEQ ID NO: 2661 - RNA, 20 nt, Artificial Sequence
  Pandan miR-263a sensor with an extension in the stem
uuggcugcuucggcagccaa

SEQ ID NO: 2662 - RNA, 12 nt, Artificial Sequence
  Pandan bantam sensor without an extension in the stem
gugcuucggcac

SEQ ID NO: 2663 - RNA, 18 nt, Artificial Sequence
  Pandan bantam sensor with an extension in the stem
gggcugcuucggcagccc

SEQ ID NO: 2664 - RNA, 14 nt, Artificial Sequence
  Pandan miR-1000 sensor without an extension in the stem
auugcuucggcaau

SEQ ID NO: 2665 - RNA, 18 nt, Artificial Sequence
  Pandan miR-1000 sensor with an extension in the stem
uggcugcuucggcagcca

SEQ ID NO: 2666 - RNA, 95 nt, Artificial Sequence
  Computationally/mFold predicted structure of the Spinach sensor
gauguaacugaaugaaauggugaaggacggguccaguaggcugcuucggcagccuacuuguugaguagagugugagcuccguaacuaguuacauc

SEQ ID NO: 2667 - RNA, 95 nt, Artificial Sequence; identical to SEQ ID NO: 2666
  Solved crystal structure of Spinach2 sensor (simplified 2D rep)

SEQ ID NO: 2668 - RNA, 95 nt, Artificial Sequence; identical to SEQ ID NO: 2666
  Solved crystal structure of Spinach2 sensor (detailed 2D rep)

SEQ ID NO: 2669 - RNA, 133 nt, Artificial Sequence
  Single-molecule Pandan with 5' and 3' ends in added stem-loop P4
gggacaccugaguguccccugaacuuguugaguagagugugagcuccguaacuaguuacaucacgggagauguaacugaaugaaauggugaaggacggguccaguaggcugcuucggcagccuacuuguucag

SEQ ID NO: 2670 - RNA, 132 nt, Artificial Sequence; identical to SEQ ID NO: 2630
  Pandan with destabilized G-quadruplex and base triplet

SEQ ID NO: 2671 - RNA, 132 nt, Artificial Sequence; identical to SEQ ID NO: 2630
  Pandan with stabilized G-quadruplex and base triplet

SEQ ID NO: 2672 - RNA, 23 nt, Artificial Sequence
  Target micro-RNA
cuacucuacuuguucagguucag

What is claimed is:

1. An isolated nucleic acid molecule for detecting the presence of a target nucleic acid sequence, wherein the isolated nucleic acid molecule comprises the following structure:

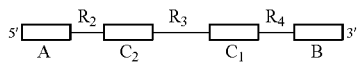

wherein each of A and B is a domain forming a stabilizing secondary structure within the domain, wherein C1 and C2 are domains that bind to the target nucleic acid sequence, wherein R2 and R4 are regions of nucleic acids that do not bind with the target nucleic acid sequence, and wherein R3 is a region of nucleic acids capable of stabilizing a detection agent upon the isolated nucleic acid molecule binding to the target nucleic acid sequence,
wherein the stabilizing secondary structure is selected from the group consisting of stems, stem loops, t-RNA type structures, cloverleaves, tetraloops, pseudoknots and combinations thereof,
wherein $R_3$ comprises a fluorophore binding pocket comprising a G-quadruplex region and a UAU base triple,
wherein the fluorophore binding pocket, the G-quadruplex region, and the UAU base triple are destabilized in the absence of the target nucleic acid sequence,
wherein the detection agent is a fluorophore that binds to the stabilized fluorophore binding pocket of $R_3$, and
wherein the isolated nucleic acid molecule is an RNA sequence.

2. The isolated nucleic acid molecule of claim 1, wherein the structure further comprises regions $R_1$ and $R_5$, wherein $R_1$ is upstream from domain A and $R_5$ is downstream from domain B, wherein $R_1$ and $R_5$ are regions of nucleic acids that do not bind with the target nucleic acid sequence, and wherein $R_1$ is a region capable of forming a secondary structure within the $R_1$ region and $R_5$ is a region capable of forming a secondary structure within the $R_5$ region.

3. The isolated nucleic acid molecule of claim 1, wherein $R_2$ is a region capable of forming a secondary or linear structure within the $R_2$ region and $R_4$ is a region capable of forming a secondary of linear structure within the $R_4$ region.

4. The isolated nucleic acid molecule of claim 3, wherein the secondary structure is selected from the group consisting of stems, stem loops, t-RNA type structures, cloverleaves, tetraloops, pseudoknots and combinations thereof.

5. The isolated nucleic acid molecule of claim 1, wherein domain A forms a stem loop within the domain A and domain B forms a stem loop within the domain B.

6. The isolated nucleic acid molecule of claim 5, wherein the stem of the stem loop formed within the domain A is independently 6 or 7 nucleotide base-pairs long and wherein the stem of stem loop formed within the domain B is independently 6 or 7 nucleotide base-pairs long.

7. The isolated nucleic acid molecule of claim 1, wherein the nucleic acids of domains $C_1$ and $C_2$ complementarily bind to the 5' and 3' ends of the target nucleic acid sequence.

8. The isolated nucleic acid molecule of claim 1, wherein domain $C_1$ is 9-13 nucleotides in length or wherein domain $C_2$ is 9-13 nucleotides in length.

9. The isolated nucleic acid molecule of claim 1, comprising a combination comprising SEQ ID NO: 1, followed by SEQ ID NO: 2658, followed by SEQ ID NO: 2659.

10. The isolated nucleic acid molecule of claim 1, comprising the sequence selected from the group consisting of SEQ ID NO: 3, SEQ ID NO: 5, SEQ ID NO: 6 and combinations thereof.

11. The isolated nucleic acid molecule of claim 1, comprising the sequence selected from the group consisting of SEQ ID NOs: 2618 to 2632, 2634, 2636, 2638, 2640, 2641, 2643, 2645, 2647, 2649, 2651, 2652 and 2654.

12. The isolated nucleic acid molecule of claim 1, wherein the target nucleic acid sequence is an RNA sequence or a miRNA sequence.

13. The isolated nucleic acid molecule of claim 12, wherein the target nucleic acid sequence is a miRNA sequence.

14. A kit comprising:
an isolated nucleic acid molecule for detecting the presence of a target nucleic acid sequence, wherein the isolated nucleic acid molecule comprises the following structure:

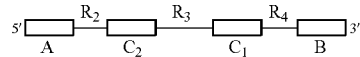

wherein each of A and B is a domain forming a stabilizing secondary structure within the domain, wherein C1 and C2 are domains that bind to the target nucleic acid sequence, wherein R2 and R4 are regions of nucleic acids that do not bind with the target nucleic acid sequence and wherein R3 is a region of nucleic acids capable of stabilizing a detection agent upon the isolated nucleic acid molecule binding to the target nucleic acid sequence, wherein the stabilizing secondary structure is selected from the group consisting of stems, stem loops, t-RNA type structures, cloverleaves, tetraloops, pseudoknots and combinations thereof, wherein $R_3$ comprises a fluorophore binding pocket comprising a G-quadruplex region and a UAU base triple, wherein the fluorophore binding pocket, the G-quadruplex region, and the UAU base triple are destabilized in the absence of the target nucleic acid sequence, wherein the isolated nucleic acid molecule is an RNA sequence; and wherein the detection agent is a fluorophore that binds to the stabilized fluorophore binding pocket of $R_3$.

* * * * *